(12) United States Patent
Hong et al.

(10) Patent No.: US 8,435,758 B2
(45) Date of Patent: May 7, 2013

(54) MANIPULATION OF SNF1 KINASE FOR ALTERED OIL CONTENT IN OLEAGINOUS ORGANISMS

(75) Inventors: Seung-Pyo Hong, Hockessin, DE (US); Quinn Qun Zhu, West Chester, PA (US); John E. Seip, Alloway, NJ (US)

(73) Assignee: E I du Pont de Nemours and Company, Wilmington, DE (US)

( * ) Notice: Subject to any disclaimer, the term of this patent is extended or adjusted under 35 U.S.C. 154(b) by 628 days.

(21) Appl. No.: 12/549,439

(22) Filed: Aug. 28, 2009

(65) Prior Publication Data

US 2010/0062502 A1   Mar. 11, 2010

Related U.S. Application Data

(60) Provisional application No. 61/093,007, filed on Aug. 29, 2008.

(51) Int. Cl.
    *C12P 1/00*     (2006.01)
    *C07H 21/04*    (2006.01)
    *C12N 1/15*     (2006.01)

(52) U.S. Cl.
    USPC .......................... 435/41; 536/23.2; 435/254.2

(58) Field of Classification Search .................. None
    See application file for complete search history.

(56) References Cited

U.S. PATENT DOCUMENTS

2004/0199940 A1   10/2004   Karunanandaa et al.
2006/0263864 A1   11/2006   Busby et al.
2007/0067869 A1    3/2007   Kourtz et al.

OTHER PUBLICATIONS

Galye et al, Identification of regions in interleukin-1 alpha important for activity. J Biol Chem. Oct. 15, 1993;268(29):22105-11.*
Whisstock et al, Prediction of protein function from protein sequence and structure. Q Rev Biophys. Aug. 2003;36(3):307-40. Review.*
UniProt_201110 database Acc. No. Q6CAK0_YARLI from Dujon et al, Genome evolution in yeasts. Nature 430:35-44(2004). Alignment with Seq Id No. 27.*
Mu et al, A role for AMP-activated protein kinase in contraction- and hypoxia-regulated glucose transport in skeletal muscle. Mol Cell. May 2001;7(5):1085-94.*
International Search Report, PCT Application No. PCT/US09/55376, Mar. 19, 2010.
J. Xu et al., Cloning and Characterization of an Acyl-Coa-Dependent Diacylglycerol Acyltransferase 1 (DGAT1) Gene From *Tropaeolum majus*, and a Study of the Functional Motifs of the DGAT Protein Using Site-Directed Mutagenesis to Modify Enzyme Activity and Oil Content, Plant Biotech. J., 6(8): 799-818 (2008).
P. Sanz et al., Regulatory Interactions Between the REG1-GLC7 Protein Phosphatase and the SNF1 Protein Kinase, Molecular and Cellular Biology, 29(4): 1321-1328 (2000).
E. M. Rubenstein et al., Regulatory Domains of SNF1-Activating Kinases Determine Pathway Specificity, Eukaryot Cell., 5(4): 620-627 (2006).
A. Rodriguez et al., The Hexokinase 2 Protein Regulates the Expression of the GLK1, HXK1 and HXK2 Genes of *Saccharomyces cerevisiae*, Biochem J., 355(3): 625-631 (2001).
R. R. McArtney et al., Regulation of SNF1 Kinase, Activation Requires Phosphorylation of Threonine 210 by an Upsstream Kinase As Well As a Distinct Step Mediated by the SNF4 Subunit, J. Biol. Chem., 276(39): 36460-36466 (2001).
K. Ludin et al., Glucose-Regulated Interaction of a Regulatory Subunit of Protein Phosphatase 1 With the SNF1 Protein Kinase in *Saccharomyces cerevisiae*, Proc. Nat'l. Acad. Sci. U.S.A., 95: 6245-6250 (1998).
K. Hedbacker et al., SNF1/AMPK Pathways in Yeast, Frontiers in Bioscience, 13: 2408-2420 (2008).
D. G. Hardie et al., The AMP-Activated/SNF1 Protein Kinase Subfasmily: Metabolic Sensors of the Eukaryotic Cell?, Annu. Rev. Biochem., 67: 821-855 (1998).
J. Ha et al., Critical Phosphorylation Sites for Acetyl-Coa Carboxylase Activity, J. Biol. Chem., 269(35): 22162-22168 (1994).
F. Estruch et al., N-Terminal Mutations Modulate Yeast SNF1 Protein Kinase Function, Genetics, 132: 639-650 (1992).
S. P. Davies et al., Location and Function of Three Sites Phosphorylated on Rat Acetyl-Coa Carboxylase by the AMP-Activated Protein Kinase, Eur. J. Biochem., 187: 183-190 (1990).
P. A. Covitz et al., Repression by the Yeast Meiotic Inhibitor RME1, Genes Dev., 7: 1598-1608 (1993).
M. Carlson et al., Mutants of Yeast Defective in Sucrose Utilization, Genetics, 98: 25-40 (1981).
A. Bateman, Protein Sequence Motif, the Structure of a Domain Common to Archaebacteria and the Homocystinuria Disease Protein, Trends Biochem. Sci., 22: 12-13 (1997).
D. G. Hardie et al., Review, the AMP-Activated Protein Kinase, Fuel Gauge of the Mammalian Cell?, Eur. J. Biochem., 246: 259-273 (1997).

* cited by examiner

*Primary Examiner* — Sheridan Swope

(57) ABSTRACT

Methods of increasing the total lipid content in a eukaryotic cell, the total content of polyunsaturated fatty acids ["PUFAs"], and/or the ratio of desaturated fatty acids to saturated fatty acids by reducing the activity of the heterotrimeric SNF1 protein kinase are disclosed. Preferably, the chromosomal genes encoding the Snf1 α-subunit, Gal83 β-subunit or Snf4 γ-subunit of the SNF1 protein kinase, the upstream regulatory genes encoding Sak1, Hxk2, Glk1 or Reg1, or the downstream genes encoding Rme1, Cbr1 or Snf3 are manipulated in a PUFA-producing strain of the oleaginous yeast *Yarrowia lipolytica*, resulting in increased total lipid content, as compared to the parent strain comprising the heterotrimeric SNF1 protein kinase not having reduced activity.

4 Claims, 14 Drawing Sheets

Figure 2A:
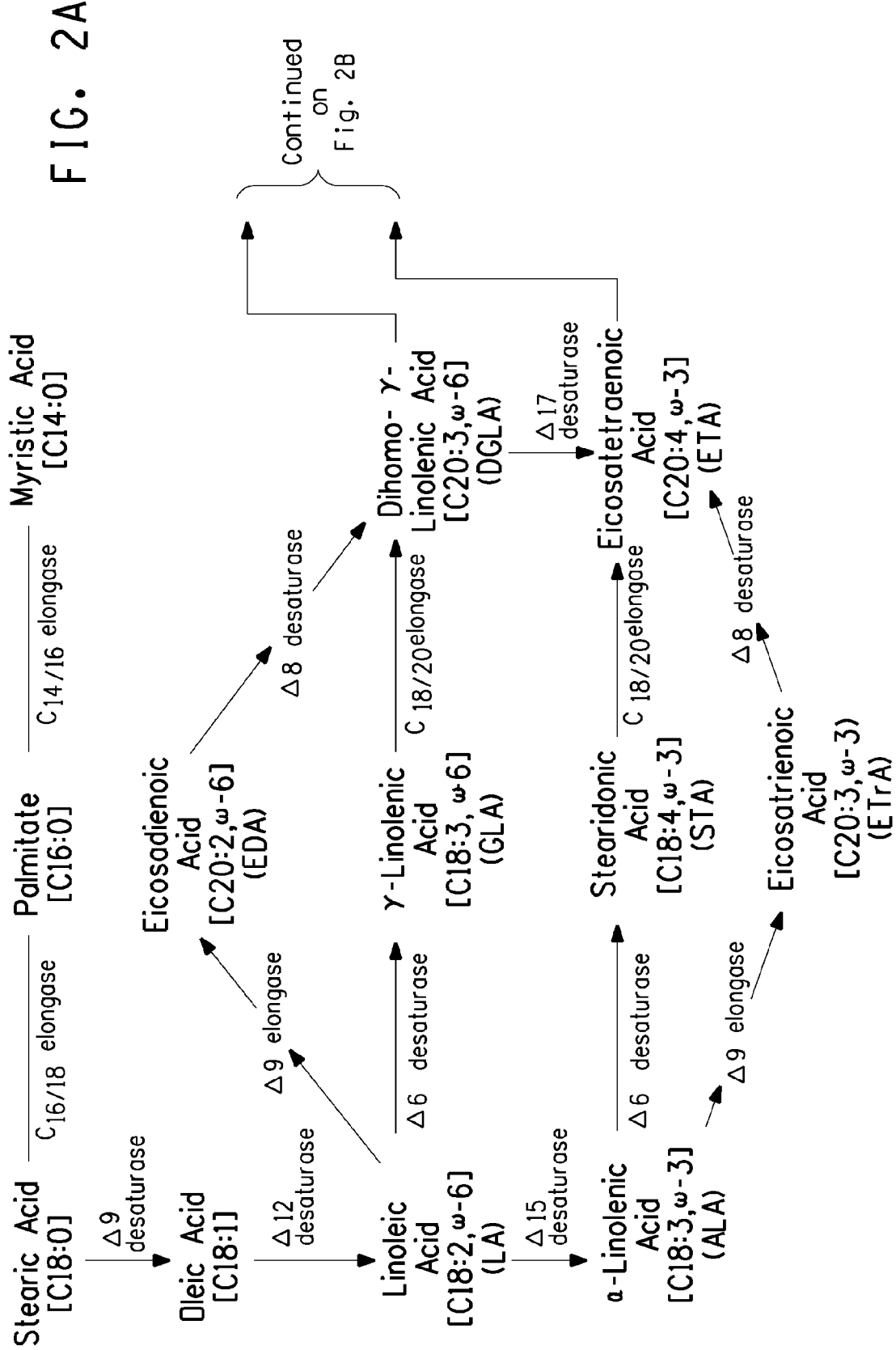

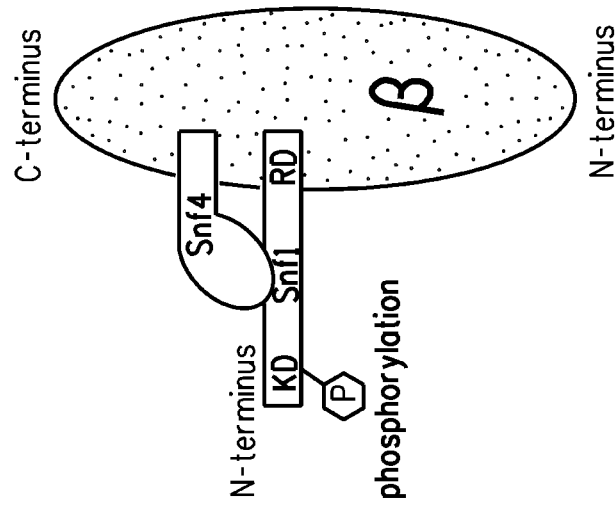
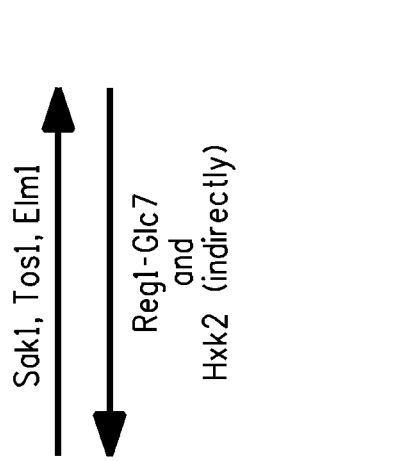
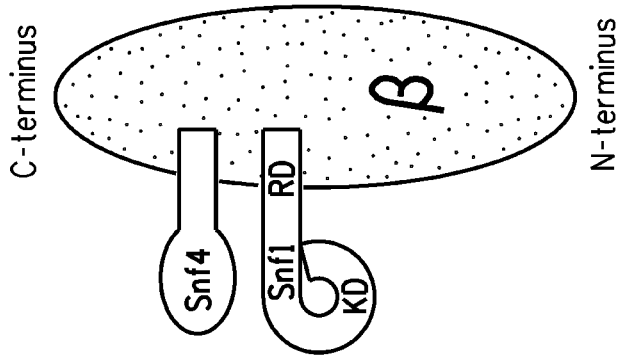
FIG. 1

```
                                                                                     50
(SEQ ID NO:27)   (1)  ------------------------------MATEHVEHAENAKQSPQ----PSFSGSESG
(SEQ ID NO:2)    (1)  MSSNNNTNTAPANANSSHHHHHHHHHHHGHGGSNSTLNNPKSSLADGA
(SEQ ID NO:25)   (1)  ------------------------------MENKEHHHHHHHHHHHSNG----SYVSNKVSSLADGS
(SEQ ID NO:21)   (1)  ---MSEQAQPQASADQQQHQHNHHHHHHHHHHHNENQSQQQVPIDPAANPAN
(SEQ ID NO:23)   (1)  ---MSEQNQGQP-DQQHSGDHQHHHHHHHHHHHSQQPAQPIPIDPNVNPAN
(SEQ ID NO:17)   (1)  ------------------------------MSHDPNQQQPHGGSGQG-----HHQRQLTNHAQGQ 100
(SEQ ID NO:27)  (27)  RIGRYQIIKTLGEGSFGKVKLAYHLATHEKVALKIINRKTLAKSDMQGRV
(SEQ ID NO:2)   (51)  HIGNYQIVKTLGEGSFGKVKLAYHTTTGQKVALKIINKKVLAKSDMQGRI
(SEQ ID NO:25)  (35)  RVGNYQIVKTLGEGSFGKVKLAYHVTTGQKVALKSINKKVLAKSDMQGRI
(SEQ ID NO:21)  (49)  RIGRYQILKTLGEGSFGKVKLAQHLGTGQKVALKIINRKTLAKSDMQGRV
(SEQ ID NO:23)  (48)  RIGRYQIIKTLGEGSFGKVKLAQHVGTGQKVALKIINRKTLAKSDMQGRV
(SEQ ID NO:17)  (31)  HIGKYQIIKTLGEGSFGKVALKIYHISTGQKVALKIINKKVLAKSDMQGRI 150
(SEQ ID NO:27)  (77)  EREISYLRLLRHPHIIKLYDVIKSKDEIIMVIEFAGKELFDYIVQRGKMP
(SEQ ID NO:2)  (101)  EREISYLRLLRHPHIIKLYDVIKSKDEIIMVIEYAGNELFDYIVQRDKMS
(SEQ ID NO:25) (85)   DREISYLRLLRHPHIIKLYDVIKSKDEIIMVIEYAGNELFDYIVQRNRMS
(SEQ ID NO:21) (99)   EREISYLRLLRHPHIIKLYDVIKSKDEIIMVIEFAGKELFDYIVQRGKMP
(SEQ ID NO:23) (98)   EREISYLRLLRHPHIIKLYDVIKSKDEIIMVIEFAGKELFDYIVQRGKMP
(SEQ ID NO:17) (81)   EREISYLRLLRHPHIIKLYDVIKSKDEIIMVIEYAGNELFDYIVQRDRMP
```

FIG. 4A

```
(SEQ ID NO:27)  (127)  EDEARRFFQQIISAVEYCHRHKIVHRDLKPENLLLDENLNVKIADFGLSN
(SEQ ID NO:2)   (151)  EQEARRFFQQIISAVEYCHRHKIVHRDLKPENLLLDEHLNVKIADFGLSN
(SEQ ID NO:25)  (135)  EQEARRFFQQIIAAVEYCHRHKIVHRDLKPENLLLDEHLNVKIADFGLSN
(SEQ ID NO:21)  (149)  EDEARRFFQQIIAAVEYCHRHKIVHRDLKPENLLLDDQLNVKIADFGLSN
(SEQ ID NO:23)  (148)  EDEARRFFQQIISAVEYCHRHKIVHRDLKPENLLLDDQLNVKIADFGLSN
(SEQ ID NO:17)  (131)  EQEARRFFQQIISAVDYCHRHKIVHRDLKPENLLLDEHLNVKIADFGLSN (SEQ ID NO:27)  (177)  IMTDGNFLKTSCGSP-NYAAPEVISGKLYAGPEVDVWSCGVILYVMLCGR
(SEQ ID NO:2)   (201)  IMTDGNFLKTSCGSP-NYAAPEVISGKLYAGPEVDVWSCGVILYVMLCRR
(SEQ ID NO:25)  (185)  IMTDGNFLKTSCGSP-NYAAPEVISGKLYAGPEVDVWSCGVILYVMLCRR
(SEQ ID NO:21)  (199)  IMTDGNFLKTSCGSPNYMPAPEVISGKLYAGPEVDVWSAGVILYVMLCGR
(SEQ ID NO:23)  (198)  IMTDGNFLKTSCGSP-NYAAPEVISGKLYAGPEVDVWSSGVILYVMLCGR
(SEQ ID NO:17)  (181)  IMTDGNFLKTSCGSP-NYAAPEVISGKLYAGPEVDVWSSGVILYVMLCRR (SEQ ID NO:27)  (226)  LPFDDEFIPNLFKKISNGVYTIPPYLSAGAKHLLQMLVVNPLNRITVQG
(SEQ ID NO:2)   (250)  LPFDDESIPVLFKNISNGVYTLPKFLSPGAAGLIKRMLIVNPINRISIHE
(SEQ ID NO:25)  (234)  LPFDDESIPVLFKNISNGVYTLPKFLSPGASDLIKRMLIVNPLNRISIHE
(SEQ ID NO:21)  (249)  LPFDDEFIPALFKKISNGVYTLPNYLSAGAKHLLTRMLVVNPLNRITIHE
(SEQ ID NO:23)  (247)  LPFDDEFIPALFKKISNGVYTLPNYLSPGAKHLLTRMLVVNPLNRITIHE
(SEQ ID NO:17)  (230)  LPFDDESIPVLFKNISNGVYTIPNFLSQGAASLIKKMLIVNPVNRITVHE
```

FIG. 4B

```
                     301                                                             350
(SEQ ID NO:27)  (276) IMEDPWFKQGIAEYLVPRDLKP----------------------DQVEIDDKVV
(SEQ ID NO:2)   (300) IMQDDWFKVDLPEYLLPPDLKPHPEENENNDSKKDGSSPDNDEIDDNLV
(SEQ ID NO:25)  (284) IMQDEWFKVDLAEYLVPQDLKQQ-EQFN------KKSGNEENVEEIDDEMV
(SEQ ID NO:21)  (299) IMEDDWFKQDMPDYLLPPDLSKN------------KNSKIDVDEDVI
(SEQ ID NO:23)  (297) IMEDEWFKQDMPDYLLPPDLSKI------------KTSKIDIDEDVI
(SEQ ID NO:17)  (280) IMQDEWFKVDLPDYLVPAESTHQENSESK----TEDGGPSVPLELIDDSLV 351                                                             400
(SEQ ID NO:27)  (308) GALSDTMGYDRD------QVYEALKAPKSDG--------TEIRDAYDLM
(SEQ ID NO:2)   (350) NILSSTMGYEKD------EIYESLESSEDTP---------AFNEIRDAYMLI
(SEQ ID NO:25)  (328) VTLSKTMGYDKD------EIYEALESSEDTP---------AYNEIRNAYILI
(SEQ ID NO:21)  (334) RALSVTMGYDRDCKIVNVIEKANKQVAAGNSSSQ-QSKSNEILDAYLLM
(SEQ ID NO:23)  (332) SALSVTMGYDRD-EIISVIEKANREAAAGGATPTNQSKSTNEVLDAYLLM
(SEQ ID NO:17)  (327) QTLSNTMGYDVD------EIYEALESDEDHP---------SINEIRDAYQLI 401                                                             450
(SEQ ID NO:27)  (343) KENR---QQLEKDS-----TVEDKVDESGKPKHQESRK-----------
(SEQ ID NO:2)   (387) KENKSLIKDMKANKSVSDELDTFLSQSPPTFQQQSKSHQKSQVDHETAKQ
(SEQ ID NO:25)  (365) KDNKSLIKUMKQDNNVTQELDTFLSQSPPTFQQNGDGMKAS--EDQKKKH
(SEQ ID NO:21)  (383) KENHALVKDLKKSK--SENIESFLSQSPPPSP-FPNRGSTS--------
(SEQ ID NO:23)  (381) KENHTLVKDLKKSK--SENIESFLSLSPPPSSSFPNPGSTS--------
(SEQ ID NO:17)  (364) KENRNLINDIKVNKQQSNDLDTFLSQSPPTFEQSLHAPPGS--------KN
```

FIG. 4C

```
                        451                                                      500
(SEQ ID NO:27)                ---NPPALTFDSHHMPTIVDHSDLRTPNTTIAVLPSSLPAYHRANMMAHG
(SEQ ID NO:2)   (373)   HARRMASAITQQRTYHQSPFMDQYKEEDSTVSIIPTSLPQIHRANMLAQG
(SEQ ID NO:25)  (437)   SGRRLASSVTQQRTFHQPPFMDQSKEEDSTIS-IPTSLPQIHRANMLAQG
(SEQ ID NO:21)  (413)   ---SAPGVQQSLTYQTLATVPDLSTLPNSTIAILPTSLPSIHRAYMAETK
(SEQ ID NO:23)  (421)   ---SAPGVQQSLTYQTLATVPDLSTLPNSTIAILPTSLPSIHRAYMPETK
(SEQ ID NO:17)  (420)   RHSHRHSKRTQQRTYQYHYGNG--SQDGDSTIAILPSSLPQIHRANMVAQG
                                                                           (407)

501                                                      550
(SEQ ID NO:27)          --PATLRKLNPISSRKSKTRWHFGIRSKSYPLDVMGELYRALKNLGAEWA
(SEQ ID NO:2)   (420)   --SPAASKISPLVTKKSKTRWHFGIRSRSYPLDVMGEIYTALKNLGAEWA
(SEQ ID NO:25)  (487)   --LPAASKISPLVTKKSKTRWHFGIRSRSYPLDVMGHIYIALKNLGAEWA
(SEQ ID NO:21)  (462)   QNGDPSQQHAPPTKKSKTRWHFGIRSRSYPLDVMGEIYRALKNLGAEWA
(SEQ ID NO:23)  (468)   VNDPQQQIPAPQPTKKIKTRWHFGIRSRSYPLDVMGEIYRALKNLGAEWA
(SEQ ID NO:17)  (467)   --SQAAAKISPLSVKKSKTRWHFGIRSRSYPLDVMGEIYIALKNLGAEWA
                        (456)

551                                                      600
(SEQ ID NO:27)  (468)   KPSENDLWTIRVRWRITPEK-DESDSTTKPDSGLLKMQIQLYLLEQNSYL
(SEQ ID NO:2)   (535)   KPSEEDLWTIKLRWKYDIGNKTNTN----EKIPDLMKMVIQLFQIETNNYL
(SEQ ID NO:25)  (510)   NPSEEDLWTIRVRWKYDSDESRLIEDGVKKIPNLMKIVIQLFQIETNNYL
(SEQ ID NO:21)  (518)   KPTEEELWTIRVRWKYD------TSAQFECGSAPNLMKMQIQLFQLEPNNYL
(SEQ ID NO:23)  (517)   KPTEEELWTIRVRWKYD----STPQLRVWQRTNLMKMQIQLEQLEPNNYL
(SEQ ID NO:17)  (504)   KPSEEDLWTIRVRWRYNIDMPDDEMKN-KOIPDLMKMVIQLFQIETNNYL
```

FIG. 4D

```
                          601                                                      650
(SEQ ID NO:27)   (517)    VDFKFDGWECETESGEIKTRDVAQVSNSKSANETFTFSAYPFLHLATRLI
(SEQ ID NO:2)    (582)    VDFKFDGWESSYGDD-------TIVSNISEDEMSTFSAYPFLHLTTKLI
(SEQ ID NO:25)   (560)    VDFKFDGWESTYGDS-------TISTNMSEDEMSTFSAYPFLHLTTKLI
(SEQ ID NO:21)   (564)    VSFKFSGWESAHGNA----GTDSPQSHRQQDLDEVGSFSAYPFLHLATRLI
(SEQ ID NO:23)   (563)    VDFKFDGWEQTSDES----KNDASLDYKQQDLDEVGSFSAYPFLHLATRLI
(SEQ ID NO:17)   (553)    VDFKFDGWESSNG---------VVYSSRNDDEMSTFSAYPFLHLATRLI 651    663
(SEQ ID NO:27)   (567)    MELAVSSQKESEK
(SEQ ID NO:2)    (624)    MELAVNSQSN---
(SEQ ID NO:25)   (602)    MELAVNSQGN---
(SEQ ID NO:21)   (611)    MELAVNSQSG---
(SEQ ID NO:23)   (610)    MELAVNSQSG---
(SEQ ID NO:17)   (593)    MELAVNSQGS---
```

FIG. 4E

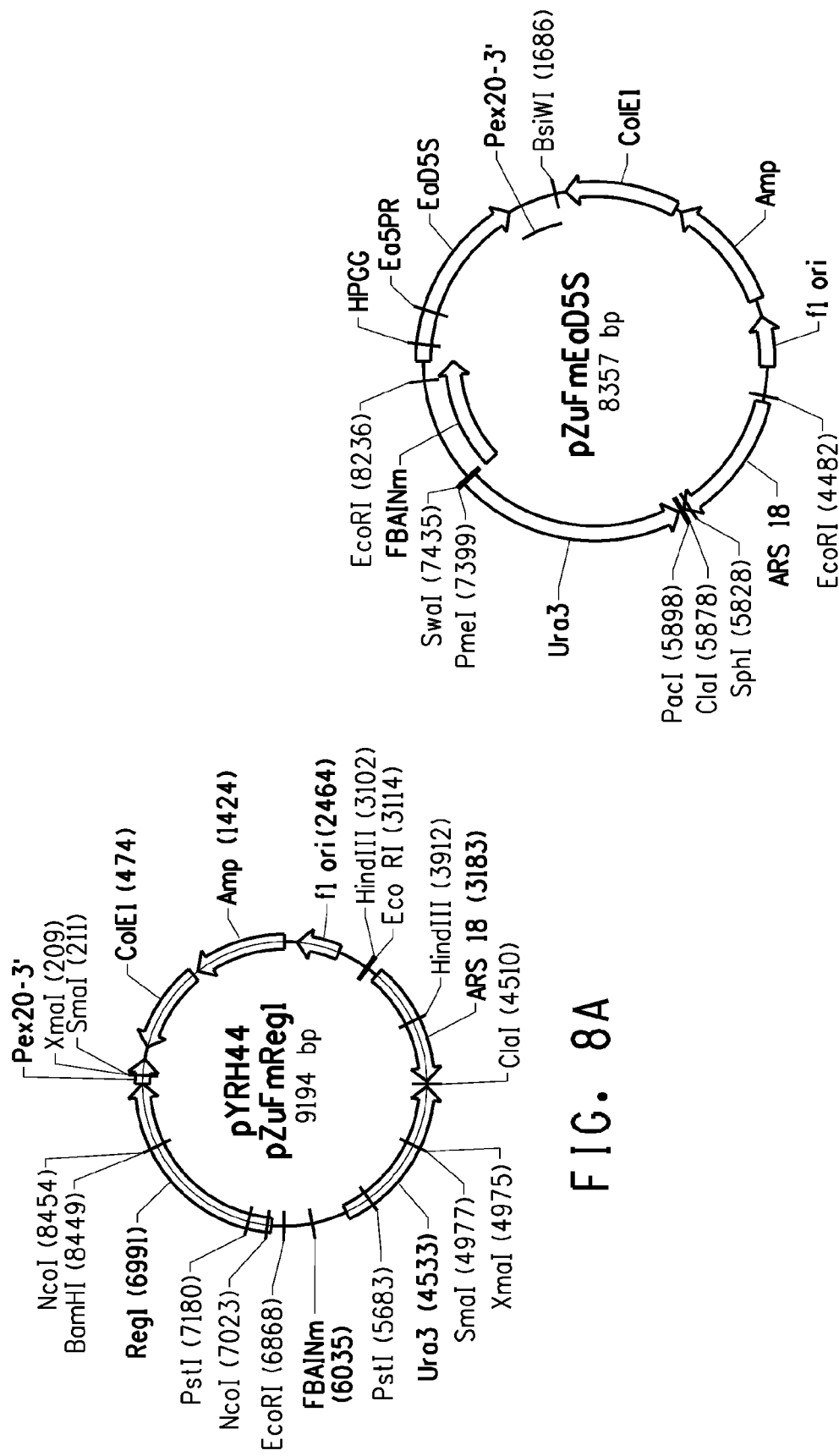

US 8,435,758 B2

MANIPULATION OF SNF1 KINASE FOR ALTERED OIL CONTENT IN OLEAGINOUS ORGANISMS

This application claims the benefit of U.S. Provisional Application No. 61/093,007, filed Aug. 29, 2008, the disclosure of which is hereby incorporated by reference in its entirety.

FIELD OF THE INVENTION

This invention is in the field of biotechnology. More specifically, this invention pertains to methods useful for manipulating oil content within the lipid fractions of oleaginous organisms based on reduction in activity of the heterotrimeric SNF1 protein kinase, a global regulator of gene expression.

BACKGROUND OF THE INVENTION

Global regulatory systems modulate the expression of numerous genes located throughout the genome, permitting the overall physiological, metabolic, and developmental status of the organism to respond rapidly and sometimes dramatically to changes in the environment. The term "global regulator" describes a relatively small number of genes whose products have a wide-ranging influence on the state of the cell. One function of these regulators is to code for products that bind promoter elements, such as enhancers or silencers, of the gene whose expression they influence; other regulators function by activating or inactivating a cascading series of cellular reactions. The potential to create powerful regulatory systems in microbial strains using these regulators is only now beginning to be appreciated.

The health benefits associated with polyunsaturated fatty acids ["PUFAs'] have been well documented. As a result, considerable research has been directed toward production of large-scale quantities of PUFAs by: 1) cultivation of microbial organisms, such as heterotrophic diatoms *Cyclotella* sp. and *Nitzschia* sp.; *Pseudomonas, Alteromonas* or *Shewanella* species; filamentous fungi of the genus *Pythium*; or *Mortierella elongata, M. exigua* or *M. hygrophila*, that natively produce the fatty acid of choice; and 2) discovery of fatty acid desaturase and elongase genes that permit synthesis of fatty acids and subsequent introduction of these genes into organisms that do not natively produce ω-3/ω-6 PUFAs via genetic engineering methods. However, commercial exploitation of this work has been limited because of limited production of the preferred ω-3/ω-6 PUFAs and/or inability to substantially improve the yield of oil/control the characteristics of the oil composition produced.

Commonly owned U.S. Pat. No. 7,238,482 describes the use of oleaginous yeast *Yarrowia lipolytica* as a production host for the production of PUFAs. Oleaginous yeast are defined as those yeast that are naturally capable of oil synthesis and accumulation, where greater than 25% of the cellular dry weight is typical. Optimization of the production host has been described in the art (see for example Intl. App. Pub. No. WO 2006/033723, U.S. Pat. Appl. Pub. No. 2006-0094092, U.S. Pat. Appl. Pub. No. 2006-0115881, U.S. Pat. Appl. Pub. No. 2006-0110806 and U.S. Pat. Appl. Pub. No. 2009-0093543-A1). The recombinant strains described therein comprise various chimeric genes expressing multiple copies of heterologous desaturases and elongases, and optionally comprise various native desaturase, acyltransferase and peri-oxisome biogenesis protein knockouts to enable PUFA synthesis and accumulation.

Further optimization of the host cell is needed for commercial production of PUFAs. The inventors were interested in identifying a global regulator in oleaginous organisms that would uncouple the process of lipid biosynthesis from the oleaginous stage of growth. Such a regulatory element would be extremely desirable because it would possess broad specificity for the activation and/or repression of secondary metabolite genes while providing strains capable of otherwise normal or near-normal development and growth.

It has been found that reduction in activity of the heterotrimeric SNF1 protein kinase results in increased accumulation of lipids in *Yarrowia lipolytica*. Despite numerous previous studies concerning the heterotrimeric SNF1 protein kinase network, many details concerning the cellular role of SNF1 protein kinase and its regulation are still not fully understood and remain to be elucidated. Also, previous studies of SNF1 knockouts have not been performed in an oleaginous organism. Although the AMPK/SNF1 kinase family is highly conserved throughout eukaryotes and required for the maintenance of cellular energy homeostasis, its specific regulatory mode may be different among different organisms.

This appears to be the first discovery of a generalized mechanism wherein reduction in the activity of the heterotrimeric SNF1 protein kinase leads to the surprising discovery of increased lipid biosynthesis, resulting in constitutive oleaginy.

SUMMARY OF THE INVENTION

In a first embodiment, the instant invention concerns a transgenic oleaginous eukaryotic host cell comprising:
  (a) a heterotrimeric SNF1 protein kinase having reduced activity when compared to the activity of a heterotrimeric SNF1 protein kinase of a non-transgenic oleaginous eukaryotic host cell; and,
  (b) an increase in total lipid content when compared to the total lipid content of a non-transgenic oleaginous eukaryotic host cell comprising a heterotrimeric SNF1 protein kinase not having reduced activity.

In a second embodiment, the invention concerns the transgenic oleaginous eukaryotic host cell as described herein wherein the reduction in activity of the heterotrimeric SNF1 protein kinase and increase in total lipid content is due to a modification selected from the group consisting of:
  (a) altering an upstream regulatory protein associated with the heterotrimeric SNF1 protein kinase;
  (b) altering a polynucleotide encoding a subunit of the heterotrimeric SNF1 protein kinase; and,
  (c) altering a downstream protein regulated by the heterotrimeric SNF1 protein kinase.

In a third embodiment, the invention concerns a transgenic oleaginous eukaryotic host cell of the invention wherein the reduction in activity of the heterotrimeric SNF1 protein kinase and increase in total lipid content is due to a modification selected from the group consisting of:
  (a) down-regulation of an upstream regulatory protein associated with the heterotrimeric SNF1 protein kinase, said upstream regulatory protein being a kinase selected from the group consisting of Sak1 and Tos3;
  (b) up-regulation of an upstream regulatory protein associated with the heterotrimeric SNF1 protein kinase, said upstream regulatory protein being a hexokinase consisting of hexokinase isoenzyme 2 (Hxk2);
  (c) up-regulation of an upstream regulatory protein associated with the heterotrimeric SNF1 protein kinase, said upstream regulatory protein being a glucokinase (Glk1);

(d) up-regulation of an upstream regulatory protein associated with the heterotrimeric SNF1 protein kinase, said upstream regulatory protein being a protein of the Reg1-Glc7 protein-phosphatase 1 complex, selected from the group consisting of Reg1 and Glc7;

(e) down-regulation of a polynucleotide encoding the SNF1 α-subunit of the heterotrimeric SNF1 protein kinase;

(f) up-regulation of the regulatory domain of a polynucleotide encoding the SNF1 α-subunit of the heterotrimeric SNF1 protein kinase;

(g) up-regulation of a catalytically inactive Snf1 α-subunit;

(h) down-regulation of a polynucleotide encoding the SNF1 β-subunit of the heterotrimeric SNF1 protein kinase, said β-subunit consisting of Gal83;

(i) down-regulation of a polynucleotide encoding the SNF1 γ-subunit of the heterotrimeric SNF1 protein kinase;

(j) up-regulation of a downstream protein regulated by the heterotrimeric SNF1 protein kinase, said downstream protein being a zinc-finger protein selected from the group consisting of Rme1 and Mhy1;

(k) up-regulation of a downstream protein regulated by the heterotrimeric SNF1 protein kinase, said downstream protein being a microsomal cytochrome $b_5$ reductase (Cbr1);

(l) up-regulation of a downstream protein regulated by the heterotrimeric SNF1 protein kinase, said downstream protein being a glucose transporter (Snf3);

(m) up-regulation of a mutant variant of a downstream protein regulated by phosphorylation by the heterotrimeric SNF1 protein kinase, said downstream protein being a protein selected from the group consisting of acetyl-CoA carboxylase and diacylglycerol acyltransferase, and wherein said mutant variant can not be phosphorylated by the heterotrimeric SNF1 protein kinase.

In a fourth embodiment, the invention concerns the oleaginous eukaryotic host cell as described herein wherein the polynucleotide encoding the α-subunit of the SNF1 protein kinase comprises an isolated Snf1 nucleotide molecule comprising:

a) a nucleotide sequence encoding a polypeptide having serine/threonine protein kinase activity, wherein the polypeptide has at least 80% amino acid identity, based on the BLASTP method of alignment, when compared to an amino acid sequence selected from the group consisting of: SEQ ID NO:2, SEQ ID NO:17, SEQ ID NO:21, SEQ ID NO:23, SEQ ID NO:25, SEQ ID NO:27;

b) a nucleotide sequence encoding a polypeptide having serine/threonine protein kinase activity, wherein the nucleotide sequence has at least 80% sequence identity, based on the BLASTN method of alignment, when compared to a nucleotide sequence selected from the group consisting of: SEQ ID NO:1, SEQ ID NO:16, SEQ ID NO:20, SEQ ID NO:22, SEQ ID NO:24 and SEQ ID NO:26;

c) a nucleotide sequence encoding a polypeptide having serine/threonine protein kinase activity, wherein the nucleotide sequence hybridizes under stringent conditions to a nucleotide sequence selected from the group consisting of: SEQ ID NO:1, SEQ ID NO:16, SEQ ID NO:20, SEQ ID NO:22, SEQ ID NO:24 and SEQ ID NO:26; or, d) a complement of the nucleotide sequence of (a), (b) or (c), wherein the complement and the nucleotide sequence consist of the same number of nucleotides and are 100% complementary.

In a fifth embodiment, the invention comprises a transgenic oleaginous eukaryotic host cell as described herein wherein the oleaginous eukaryotic host cell is selected from the group consisting of algae, fungi, oomycetes, euglenoids, stramenopiles and yeast. In particular, the yeast said is selected from the group consisting of *Yarrowia, Candida, Rhodotorula, Rhodosporidium, Cryptococcus, Trichosporon* and *Lipomyces*. The preferred yeast is *Yarrowia lipolytica*.

Also within the scope of this invention are oil or lipids obtained from the transgenic oleaginous eukaryotic host cell of the invention.

In a sixth embodiment, the invention concerns a method for increasing the total lipid content of an oleaginous eukaryotic host cell comprising a heterotrimeric SNF1 protein kinase, said method comprising:

(a) transforming the oleaginous eukaryotic host cell whereby there is a reduction in activity of the heterotrimeric SNF1 protein kinase when compared to the level of activity of a heterotrimeric SNF1 protein kinase in a non-transformed oleaginous eukaryotic host cell;

(b) growing the transformed cell of step (a) under suitable conditions whereby the total content of lipid is increased when compared to the total content of lipid obtained from a non-transformed oleaginous eukaryotic host cell having a heterotrimeric SNF1 protein kinase without reduced activity; and (c) optionally, recovering oil or lipids from the cell of step (b).

In a seventh embodiment, the invention concern a method wherein the oleaginous eukaryotic host cell having a heterotrimeric SNF1 protein kinase is transformed by a modification selected from the group consisting of:

(a) altering an upstream regulatory protein associated with the heterotrimeric SNF1 protein kinase;

(b) altering a polynucleotide encoding a subunit of the heterotrimeric SNF1 protein kinase; and (c) altering a downstream protein regulated by the heterotrimeric SNF1 protein kinase.

In an eighth embodiment, the invention concerns a method wherein the modification is selected from the group consisting of:

(a) down-regulation of an upstream regulatory protein associated with the heterotrimeric SNF1 protein kinase, said upstream regulatory protein being a kinase selected from the group consisting of Sak1 and Tos3;

(b) up-regulation of an upstream regulatory protein associated with the heterotrimeric SNF1 protein kinase, said upstream regulatory protein being a hexokinase consisting of hexokinase isoenzyme 2 (Hxk2);

(c) up-regulation of an upstream regulatory protein associated with the heterotrimeric SNF1 protein kinase, said upstream regulatory protein being a glucokinase (Glk1);

(d) up-regulation of an upstream regulatory protein associated with the heterotrimeric SNF1 protein kinase, said upstream regulatory protein being a protein of the Reg1-Glc7 protein-phosphatase 1 complex, selected from the group consisting of Reg1 and Glc7;

(e) down-regulation of a polynucleotide encoding the SNF1 α-subunit of the heterotrimeric SNF1 protein kinase;

(f) up-regulation of the regulatory domain of a polynucleotide encoding the SNF1 α-subunit of the heterotrimeric SNF1 protein kinase;

(g) up-regulation of a catalytically inactive Snf1 α-subunit;
(h) down-regulation of a polynucleotide encoding the SNF1-subunit of the heterotrimeric SNF1 protein kinase, said β-subunit consisting of Gal83;
(i) down-regulation of a polynucleotide encoding the SNF1 γ-subunit of the heterotrimeric SNF1 protein kinase;
(j) up-regulation of a downstream protein regulated by the heterotrimeric SNF1 protein kinase, said downstream protein being a zinc-finger protein selected from the group consisting of Rme1 and Mhy1;
(k) up-regulation of a downstream protein regulated by the heterotrimeric SNF1 protein kinase, said downstream protein being a microsomal cytochrome $b_5$ reductase (Cbr1);
(l) up-regulation of a downstream protein regulated by the heterotrimeric SNF1 protein kinase, said downstream protein being a glucose transporter (Snf3);
(m) up-regulation of a mutant variant of a downstream protein regulated by phosphorylation by the heterotrimeric SNF1 protein kinase, said downstream protein being a protein selected from the group consisting of acetyl-CoA carboxylase and diacylglycerol acyltransferase, and wherein said mutant variant can not be phosphorylated by the heterotrimeric SNF1 protein kinase.

In a ninth embodiment, the invention concerns a method wherein the polynucleotide encoding the Snf1 α-subunit of the SNF1 protein kinase comprises an isolated nucleotide molecule comprising:
  a) a nucleotide sequence encoding a polypeptide having serine/threonine protein kinase activity, wherein the polypeptide has at least 80% amino acid identity, based on the BLASTP method of alignment, when compared to an amino acid sequence selected from the group consisting of: SEQ ID NO:2, SEQ ID NO:17, SEQ ID NO:21, SEQ ID NO:23, SEQ ID NO:25, SEQ ID NO:27;
  b) a nucleotide sequence encoding a polypeptide having serine/threonine protein kinase activity, wherein the nucleotide sequence has at least 80% sequence identity, based on the BLASTN method of alignment, when compared to a nucleotide sequence selected from the group consisting of: SEQ ID NO:1, SEQ ID NO:16, SEQ ID NO:20, SEQ ID NO:22, SEQ ID NO:24 and SEQ ID NO:26;
  c) a nucleotide sequence encoding a polypeptide having serine/threonine protein kinase activity, wherein the nucleotide sequence hybridizes under stringent conditions to a nucleotide sequence selected from the group consisting of: SEQ ID NO:1, SEQ ID NO:16, SEQ ID NO:20, SEQ ID NO:22, SEQ ID NO:24 and SEQ ID NO:26; or,
  d) a complement of the nucleotide sequence of (a), (b) or (c), wherein the complement and the nucleotide sequence consist of the same number of nucleotides and are 100% complementary.

The oleaginous eukaryotic host cell can be selected from the group consisting of algae, fungi, oomycetes, euglenoids, stramenopiles and yeast. Preferably, the yeast said is selected from the group consisting of Yarrowia, Candida, Rhodotorula, Rhodosporidium, Cryptococcus, Trichosporon and Lipomyce. Most preferably, the yeast is Yarrowia lipolytica.

In a tenth embodiment, the invention concerns a method for increasing the total content of polyunsaturated fatty acids in the microbial oil obtained from an oleaginous eukaryotic host cell comprising a heterotrimeric SNF1 protein kinase, said method comprising:

(a) transforming the oleaginous eukaryotic host cell with isolated polynucleotides encoding a functional polyunsaturated fatty acid biosynthetic pathway wherein there is also a reduction in activity of the heterotrimeric SNF1 protein kinase when compared to the level of activity of a heterotrimeric SNF1 protein kinase in a non-transformed oleaginous eukaryotic host cell;
(b) growing the transformed cell of step (a) under suitable conditions whereby the total content of lipid is increased when compared to the total content of lipid obtained from a non-transformed oleaginous eukaryotic host cell having a heterotrimeric SNF1 protein kinase without reduced activity; and
(c) optionally, recovering oil or lipids from the cell of step (b).

In an eleventh embodiment, the invention concerns the method as described herein wherein genes encoding the functional polyunsaturated fatty acid are selected from the group consisting of Δ9 desaturase, Δ12 desaturase, Δ6 desaturase, Δ5 desaturase, Δ17 desaturase, Δ8 desaturase, Δ15 desaturase, Δ4 desaturase, $C_{14/16}$ elongase, $C_{16/18}$ elongase, $C_{18/20}$ elongase, $C_{20/22}$ elongase and Δ9 elongase and the reduction in activity of the heterotrimeric SNF1 protein kinase is due to a modification selected from the group consisting of:
  (a) altering an upstream regulatory protein associated with the heterotrimeric SNF1 protein kinase;
  (b) altering a polynucleotide encoding a subunit of the heterotrimeric SNF1 protein kinase; and
  (c) altering a downstream protein regulated by the heterotrimeric SNF1 protein kinase.

Furthermore, the polyunsaturated fatty acid can be an ω-3 fatty acid or an ω-6 fatty acid.

BIOLOGICAL DEPOSITS

The following biological material has been deposited with the American Type Culture Collection (ATCC), 10801 University Boulevard, Manassas, Va. 20110-2209, and bears the following designation, accession number and date of deposit.

| Biological Material | Accession No. | Date of Deposit |
| --- | --- | --- |
| Yarrowia lipolytica Y4127 | ATCC PTA-8802 | Nov. 29, 2007 |

The biological material listed above was deposited under the terms of the Budapest Treaty on the International Recognition of the Deposit of Microorganisms for the Purposes of Patent Procedure. The listed deposit will be maintained in the indicated international depository for at least 30 years and will be made available to the public upon the grant of a patent disclosing it. The availability of a deposit does not constitute a license to practice the subject invention in derogation of patent rights granted by government action.

BRIEF DESCRIPTION OF THE DRAWINGS AND SEQUENCE LISTINGS

FIG. 1 schematically diagrams the heterotrimeric SNF1 protein kinase in its inactive and active forms, along with upstream regulatory proteins that affect the kinase. The heterotrimeric SNF1 protein kinase (active and inactive), as illustrated, contains a Snf4 regulatory subunit, a SNF1 catalytic subunit comprising a kinase domain (KD) and a regulatory domain (RD), and a bridging beta-subunit.

Figure 2B:
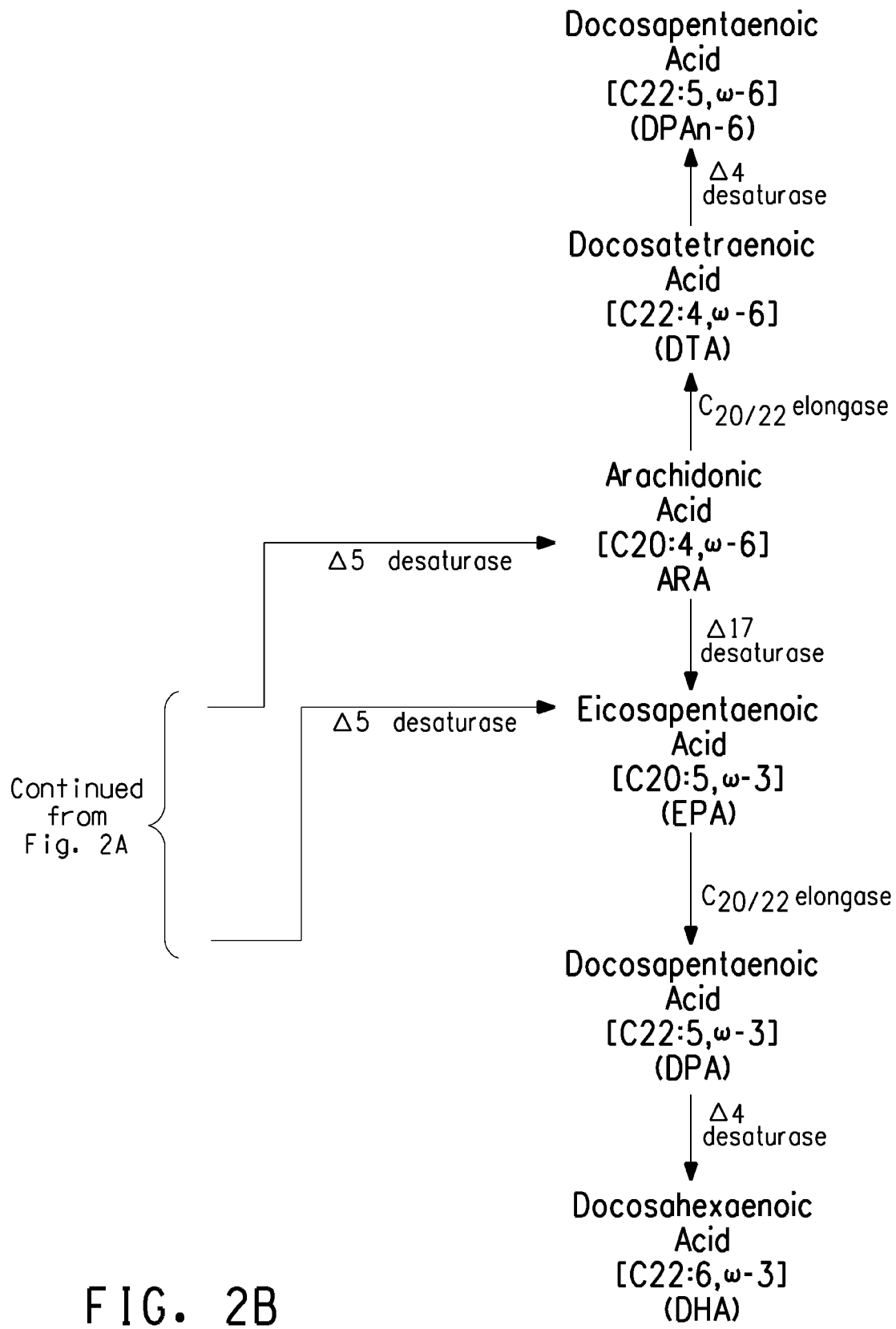

FIG. 2A and FIG. 2B illustrate the ω-3/ω-6 fatty acid biosynthetic pathway, and should be viewed together when considering the description of this pathway below.

Figure 3:
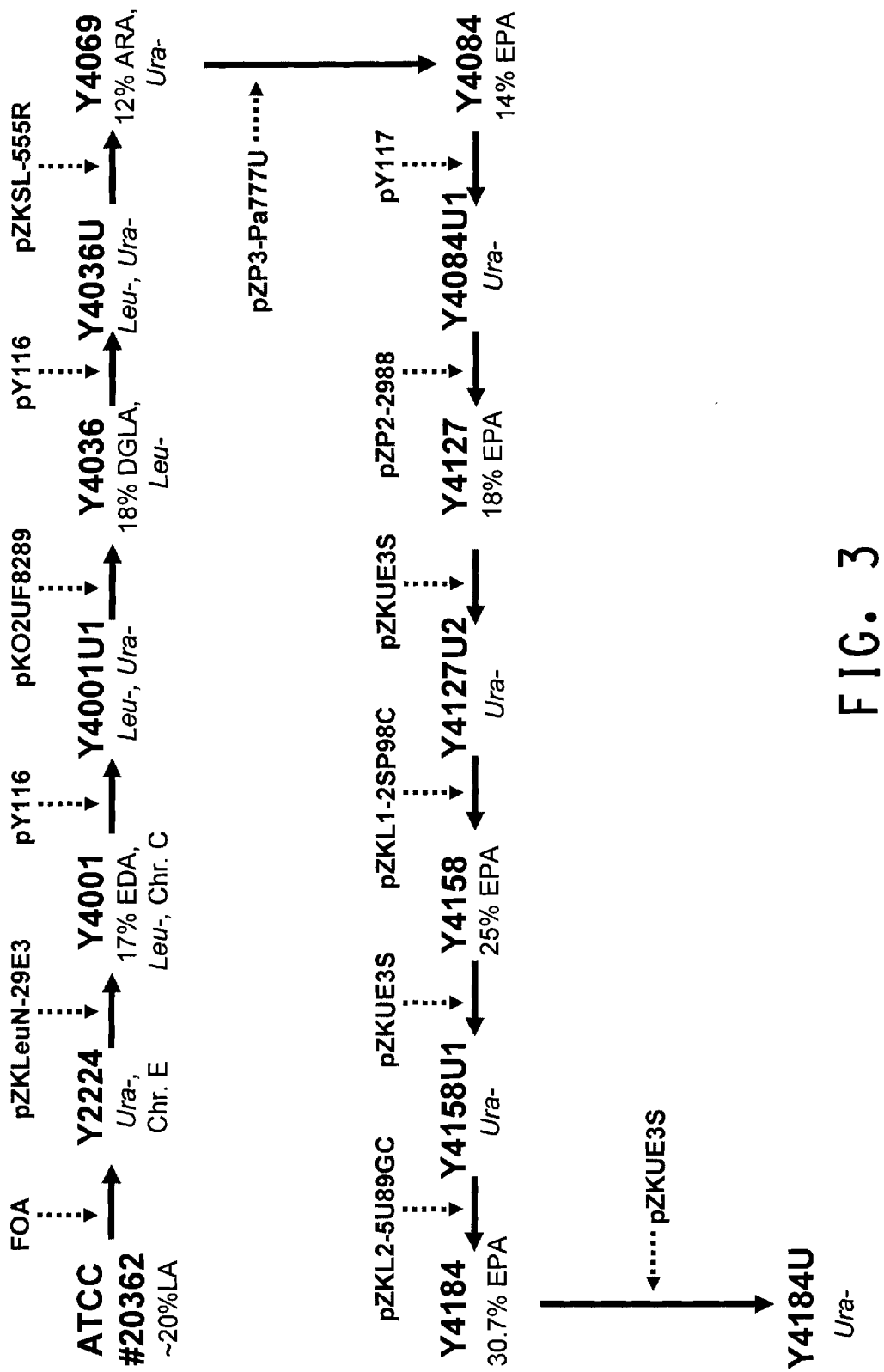

FIG. 3 diagrams the development of *Yarrowia lipolytica* strain Y4184, producing greater than 30.7% EPA in the total lipid fraction. Development of strain Y4184U is also represented.

FIG. 4A and FIG. 4B, when viewed together, show an alignment of the Snf1 α-subunit proteins of *Yarrowia lipolytica* (SEQ ID NO:27), *Saccharomyces cerevisiae* (GenBank Accession No. M13971; SEQ ID NO:2), *Kluyveromyces lactis* (GenBank Accession No. X87975; SEQ ID NO:17), *Candida albicans* (GenBank Accession No. L78129; SEQ ID NO:21), *Candida tropicalis* (GenBank Accession No. AB024535; SEQ ID NO:23) and *Candida glabrata* (GenBank Accession No. L78130; SEQ ID NO:25).

FIG. 5 provides plasmid maps for the following: (A) pYPS161; and, (B) PYRH10.

Figure 6:
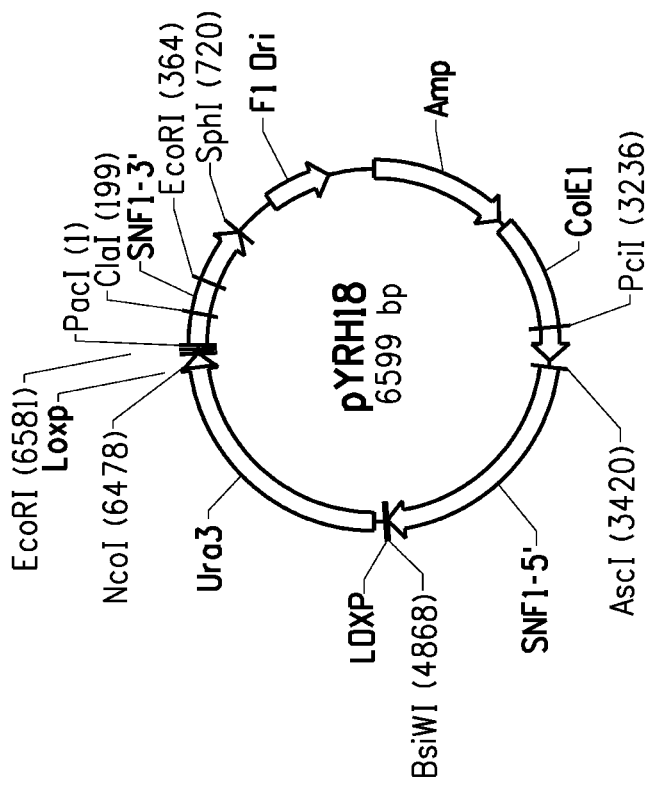

FIG. 6 provides a plasmid map for pYRH18 (SEQ ID NO:53).

Figure 7A:
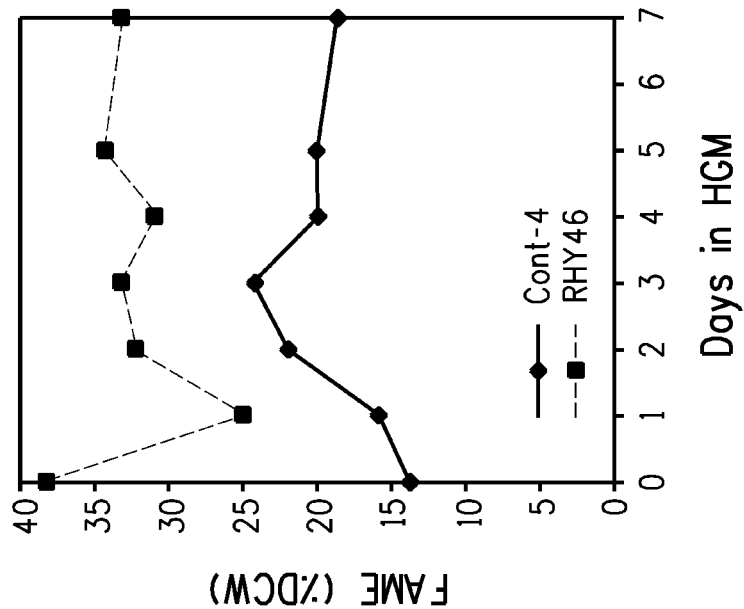
Figure 7B:
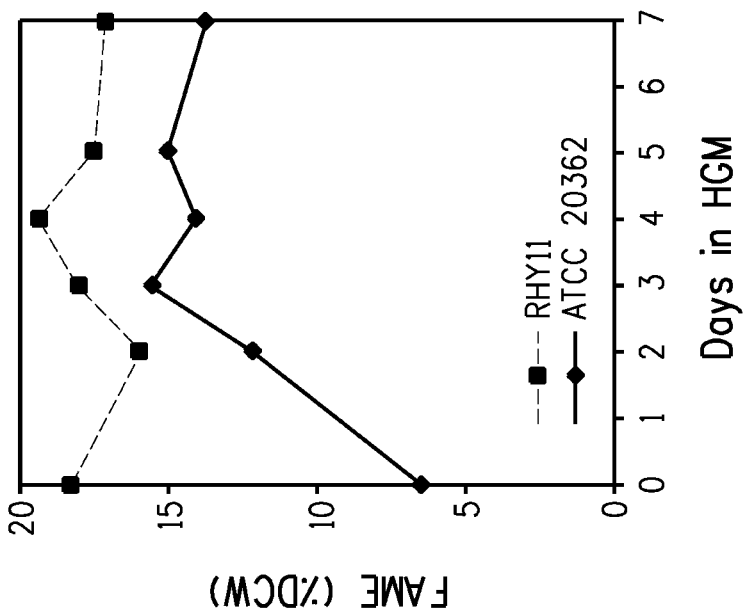

FIG. 7A is a graphical representation of the results of the time course experiment comparing lipid content as a percentage of DCW (i.e., fatty acid methyl esters ["FAME"]) in *Yarrowia lipolytica* ATCC #20362 versus the Y2224 (snf1Δ) strain, RHY11. Similarly, FIG. 7B is a graphical representation of the results of the time course experiment comparing lipid content as a percentage of DCW in a Y4184U (Ura+) control strain (i.e., strain Cont-4) and the Y4184U (snf1Δ) strain, RHY46.

FIG. 8 provides plasmid maps for the following: (A) pYRH44 (SEQ ID NO:89); and, (B) pZUFmEaD5S (SEQ ID NO:92).

Figure 9:
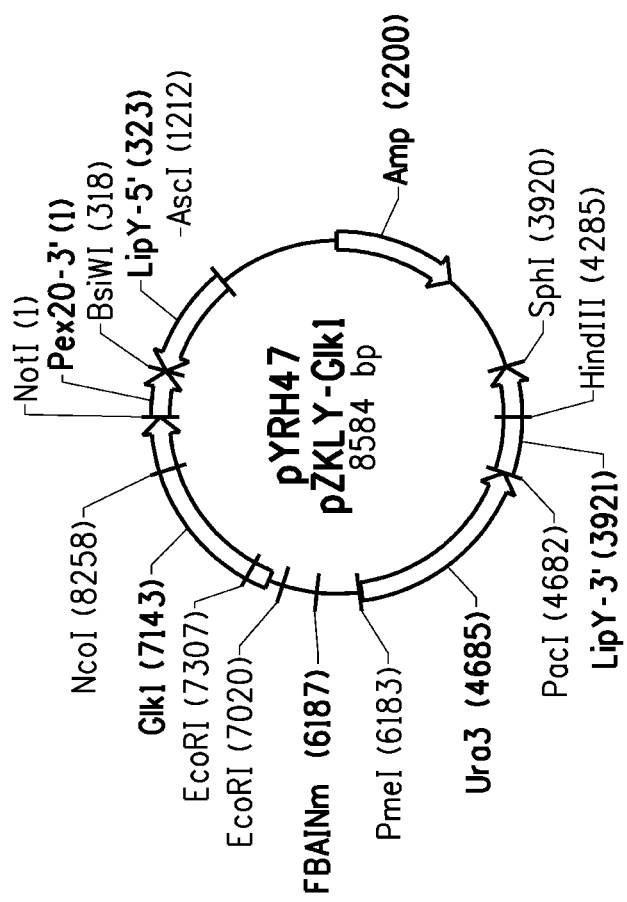

FIG. 9 provides a plasmid map for pYRH47 (SEQ ID NO:97).

The invention can be more fully understood from the following detailed description and the accompanying sequence descriptions, which form a part of this application.

The following sequences comply with 37 C.F.R. §1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

SEQ ID NOs:1-191 are ORFs encoding genes or proteins (or portions thereof), primers or plasmids, as identified in Table 1.

TABLE 1

Summary Of Nucleic Acid And Protein SEQ ID Numbers

| Description and Abbreviation | Nucleic acid SEQ ID NO. | Protein SEQ ID NO. |
|---|---|---|
| *Saccharomyces cerevisiae* serine/threonine protein kinase (GenBank Accession No. M13971) (ScSNF1) | 1 (2587 bp) | 2 (633 AA) |
| *Saccharomyces cerevisiae* SNF4 (GenBank Accession No. M30470) | 3 (1434 bp) | 4 (322 AA) |
| *Saccharomyces cerevisiae* SIP1 (GenBank Accession No. M90531) | 5 (3279 bp) | 6 (863 AA) |
| *Saccharomyces cerevisiae* SIP2 (GenBank Accession No. L31592) | 7 (1766 bp) | 8 (415 AA) |
| *Saccharomyces cerevisiae* GAL83 (GenBank Accession No. X72893) | 9 (2214 bp) | 10 (417 AA) |
| *Saccharomyces cerevisiae* SAK1 (GenBank Accession No. NC_001137, region: 417277..420705 of chromosome V) | 11 (3429 bp) | 12 (1142 AA) |
| *Saccharomyces cerevisiae* TOS3 (GenBank Accession No. NP_011336) | — | 13 (560 AA) |
| *Saccharomyces cerevisiae* ELM1 (GenBank Accession No. M81258) | 14 (2105 bp) | 15 (563 AA) |
| *Kluyveromyces lactis* FOG2 (GenBank Accession No. X87975) (KlSNF1) | 16 (2501 bp) | 17 (602 AA) |
| *Kluyveromyces lactis* GAL83/SIP2 homolog (GenBank Accession No. X75408) | 18 (1791 bp) | 19 (486 AA) |
| *Candida albicans* serine/threonine protein kinase (GenBank Accession No. L78129) (CaSNF1) | 20 (2351 bp) | 21 (620 AA) |
| *Candida tropicalis* serine/threonine protein kinase (GenBank Accession No. AB024535) (CtSNF1) | 22 (3332 bp) | 23 (619 AA) |
| *Candida glabrata* serine/threonine protein kinase (GenBank Accession No. L78130) (CgSNF1) | 24 (2184 bp) | 25 (611 AA) |
| *Yarrowia lipolytica* serine/threonine protein kinase (GenBank Accession No. CR382130 REGION: 236133..237872) (YlSNF1) | 26 (1740 bp) | 27 (579 AA) |
| *Yarrowia lipolytica* SNF4 pseudogene (Locus YALI0C03421g) | 28 (1116 bp) | — |
| *Yarrowia lipolytica* SNF4 with intron (YlSNF4) | 29 (1126 bp) | 30 (324 AA) |
| *Yarrowia lipolytica* GAL83 homolog (Locus YALI0E13926g) (YlGAL83) | 31 (1173 bp) | 32 (390 AA) |
| *Yarrowia lipolytica* GAL83 homolog (Locus YALI0C00429g) (YlSIP2) | 33 (1503 bp) | 34 (500 AA) |
| *Yarrowia lipolytica* upstream kinase of SNF1 (Locus YALI0D08822g) (YlSAK1) | 35 (2724 bp) | 36 (907 AA) |
| *Yarrowia lipolytica* upstream kinase of SNF1 (Locus YALI0B17556g) (YlELM1) | 37 (1962 bp) | 38 (653 AA) |
| Plasmid pYRH10 | 39 (6731 bp) | — |
| Plasmid pYPS161 | 40 (7966 bp) | — |
| 5' promoter region of YlSNF1 | 41 (702 bp) | — |
| 3' terminator region of YlSNF1 | 42 (719 bp) | — |
| PCR primer SNF1Fii | 43 | — |
| PCR primer SNF1Rii | 44 | — |
| PCR primer 3UTR-URA3 | 45 | — |
| PCR primer 3R-SNF1 | 46 | — |
| Real time PCR primer ef-324F | 47 | — |
| Real time PCR primer ef-392R | 48 | — |
| Real time PCR primer SNF-734F | 49 | — |
| Real time PCR primer SNF-796R | 50 | — |
| Nucleotide portion of TaqMan probe ef-345T | 51 | — |
| Nucleotide portion of TaqMan probe SNF-756T | 52 | — |
| Plasmid pYRH18 | 53 (6599 bp) | — |
| 5' promoter region of YlSNF1 | 54 (1448 bp) | — |
| *Saccharomyces cerevisiae* Glc7p (GenBank Accession No. NP_011059) | — | 55 (312 AA) |
| *Saccharomyces cerevisiae* Reg1p (GenBank Accession No. NP_010311) | — | 56 (1014 AA) |
| *Saccharomyces cerevisiae* Hexokinase isoenzyme 2 (Hxk2p) (GenBank Accession No. NP_011261) | — | 57 (486 AA) |
| Plasmid pYLoxU-ECH | 58 (6023 bp) | — |
| Plasmid pYRH28 | 59 (9182 bp) | — |
| 5' promoter region of YlSNF4 | 60 (2364 bp) | — |

TABLE 1-continued

Summary Of Nucleic Acid And Protein SEQ ID Numbers

| Description and Abbreviation | Nucleic acid SEQ ID NO. | Protein SEQ ID NO. |
|---|---|---|
| 3' terminator region of YISNF4 | 61 (1493 bp) | — |
| Primer SNF4Fii | 62 | — |
| Primer SNF4Rii | 63 | — |
| Primer SNF4-conf | 64 | — |
| Plasmid pYRH30 | 65 (8100 bp) | — |
| Plasmid pYRH33 | 66 (9963 bp) | — |
| 5' promoter region of YIGAL83 | 67 (745 bp) | — |
| 3' terminator region of YIGAL83 | 68 (2030 bp) | — |
| 5' promoter region of YISIP2 | 69 (2933 bp) | — |
| 3' terminator region of YISIP2 | 70 (1708 bp) | — |
| Primer GAL83-367F | 71 | — |
| Primer GAL83-430R | 72 | — |
| Primer SIP2-827F | 73 | — |
| Primer SIP2-889R | 74 | — |
| Nucleotide portion of TaqMan probe GAL83-388T | 75 | — |
| Nucleotide portion of TaqMan probe SIP2-847T | 76 | — |
| Plasmid pYRH31 | 77 (9624 bp) | — |
| Plasmid pYRH54 | 78 (8080 bp) | — |
| 5' promoter region of YIELM1 | 79 (2542 bp) | — |
| 3' terminator region of YIELM1 | 80 (1757 bp) | — |
| 5' promoter region of YISAK1 | 81 (1038 bp) | — |
| 3' terminator region of YISAK1 | 82 (1717 bp) | — |
| Primer ELM1-1406F | 83 | — |
| Primer ELM1-1467R | 84 | — |
| Primer SAK1-210F | 85 | — |
| Primer SAK1-272R | 86 | — |
| Nucleotide portion of TaqMan probe ELM1-1431T | 87 | — |
| Nucleotide portion of TaqMan probe SAK1-231T | 88 | — |
| Plasmid pYRH44 | 89 (9194 bp) | — |
| locus YALI0B16808g (YIREG1) | 90 (2202 bp) | 91 (733 AA) |
| Plasmid pZuFmEaD5s | 92 (8357 bp) | — |
| Primer REG1-F | 93 | — |
| Primer REG1-R | 94 | — |
| Plasmid pYRH45 | 95 (9033 bp) | — |
| Plasmid pYRH46 | 96 (8387 bp) | — |
| Plasmid pYRH47 | 97 (8584 bp) | — |
| locus YALI0B22308g (YIHXK1) | 98 (2041 bp) | 99 (534 AA) |
| locus YALI0E20207g (YIHXK2) | 100 (1395 bp) | 101 (464 AA) |
| locus YALI0E15488g (YIGLK1) | 102 (1440 bp) | 103 (479 AA) |
| Primer HXK1-F | 104 | — |
| Primer HXK1-R | 105 | — |
| Primer HXK2-F | 106 | — |
| Primer HXK2-R | 107 | — |
| Primer GLK1-F | 108 | — |
| Primer GLK1-R | 109 | — |
| Plasmid pYRH38 | 110 (8574 bp) | — |
| Primer SNF1RD-F | 111 | — |
| Plasmid pYRH40 | 112 (9405 bp) | — |
| Primer YISnf1D171A-F | 113 | — |
| Primer YISnf1D171A-R | 114 | — |
| Locus YALI0E19965g (YIRME1) | 115 (1209 bp) | 116 (402 AA) |
| Plasmid pYRH49 | 117 (8201 bp) | — |
| Primer RME1-F | 118 | — |
| Primer RME1-R | 119 | — |
| Locus YALI0B21582p (MHY1) | 120 (858 bp) | 121 (285 AA) |
| Plasmid pYRH41 | 122 (8966 bp) | — |
| Plasmid pYRH42 | 123 (8713 bp) | — |
| Plasmid pYRH48 | 124 (7865 bp) | — |
| Plasmid pYRH51 | 125 (8243 bp) | — |
| locus YALI0F05962g YIASC2 | 126 (1974 bp) | 127 (657 AA) |
| locus YALI0B08558p YISKS1 | 128 (1251 bp) | 129 (416 AA) |
| locus YALI0D04983g YICBR1 | 130 (873 bp) | 131 (290 AA) |
| locus YALI0D05291g YISCS2 | 132 (1721 bp) | 133 (312 AA) |
| Primer ACS2-F | 134 | — |
| Primer ACS2-R | 135 | — |
| Primer SCS2-F | 136 | — |
| Primer SCS2-R | 137 | — |
| Primer CBR1-F | 138 | — |
| Primer CBR1-R | 139 | — |
| Primer SKS1-F | 140 | — |
| Primer SKS1-R | 141 | — |
| Plasmid pYRH50 | 142 (8540 bp) | — |
| Locus YALI0C06424g YISNF3 | 143 (1548 bp) | 144 (515 AA) |
| Primer SNF3-F | 145 | — |
| Primer SNF3-R | 146 | — |
| Rat acetyl-CoA carboxylase (GenBank Accession No. NP_071529) | — | 147 (2345 AA) |
| Consensus phosphorylation site for the AMPK/Snf1 protein kinase family (Hyd-(Xaa-Bas)-Xaa-Xaa-Ser/Thr-Xaa-Xaa-Xaa-Hyd) | — | 148 |
| Locus YALI0C11407g (ACC) | 149 (6801 bp) | 150 (2266 AA) |
| Primer REG1-1230F | 151 | — |
| Primer REG1-1296R | 152 | — |
| Nucleotide portion of TaqMan probe REG1-1254T | 153 | — |
| Primer HXK1-802F | 154 | — |
| Primer HXK1-863R | 155 | — |
| Nucleotide portion of TaqMan probe HXK1-823T | 156 | — |
| Primer HXK2-738F | 157 | — |
| Primer HXK2-799R | 158 | — |
| Nucleotide portion of TaqMan probe HXK2-759T | 159 | — |
| Primer GLK1-105F | 160 | — |
| Primer GLK1-168R | 161 | — |
| Nucleotide portion of TaqMan probe GLK1-126T | 162 | — |
| Primer RME1-853F | 163 | — |
| Primer RME1-919R | 164 | — |
| Nucleotide portion of TaqMan probe RME1-881T | 165 | — |
| Primer ACS2-YL-1527F | 166 | — |
| Primer ACS2-YL-1598R | 167 | — |

TABLE 1-continued

Summary Of Nucleic Acid And Protein SEQ ID Numbers

| Description and Abbreviation | Nucleic acid SEQ ID NO. | Protein SEQ ID NO. |
|---|---|---|
| Nucleotide portion of TaqMan probe ACS2-YL-1548T | 168 | — |
| Primer SKS1-784F | 169 | — |
| Primer SKS1-846R | 170 | — |
| Nucleotide portion of TaqMan probe SKS1-806T | 171 | — |
| Primer CBR1-461F | 172 | — |
| Primer CBR1-527R | 173 | — |
| Nucleotide portion of TaqMan probe CBR1-482T | 174 | — |
| Primer SCS2-310F | 175 | — |
| Primer SCS2-371R | 176 | — |
| Nucleotide portion of TaqMan probe SCS2-328T | 177 | — |
| Primer SNF3-999F | 178 | — |
| Primer SNF3-1066R | 179 | — |
| Nucleotide portion of TaqMan probe SNF3-1020T | 180 | — |
| *Yarrowia lipolytica* DGAT1 ("YI DGAT1") | 181 (1578 bp) | 182 (526 AA) |
| *Yarrowia lipolytica* DGAT2 ("YI DGAT2") | 183 (2119 bp) | 184 (514 AA) |
| Primer SNF-1230F | 185 | — |
| Primer SNF-1293R | 186 | — |
| Nucleotide portion of TaqMan probe SNF-1250T | 187 | — |
| Primer ACC1-F | 188 | — |
| Primer ACC-NotR | 189 | — |
| Primer ACC-NotF | 190 | — |
| Primer ACC1-R | 191 | — |

All of the patent and non-patent literature cited herein is hereby incorporated by reference in its entirety.

The following definitions are provided.

"Open reading frame" is abbreviated as "ORF".

"Polymerase chain reaction" is abbreviated as "PCR".

"American Type Culture Collection" is abbreviated as "ATCC:".

"Polyunsaturated fatty acid(s)" is abbreviated as "PUFA(s)".

"Triacylglycerols" are abbreviated as "TAGs".

"Total fatty acids" are abbreviated as "TFAs".

"Fatty acid methyl esters" are abbreviated as "FAMEs".

"Dry cell weight" is abbreviated as "DCW".

The term "invention" or "present invention" as used herein is not meant to be limiting to any one specific embodiment of the invention but applies generally to any and all embodiments of the invention as described in the claims and specification.

The term "global regulator" refers to a relatively small number of genes whose products have a wide-ranging influence on the state of the cell. One such family of regulators in eukaryotes is the highly conserved SNF1-AMPK family of protein kinases, which are required to maintain energy homeostasis, i.e., by regulation of catabolic versus anabolic energy processes in response to cellular AMP:ATP ratio in mammals, plants and fungi. This family includes three related heterotrimeric serine/threonine kinases: AMP-activated protein kinases (AMPK) in mammals; SNF1 protein kinases in yeast/fungi (originally named when the snf1 mutation was discovered in a search for *Saccharomyces cerevisiae* mutants that were unable to utilize sucrose [i.e., sucrose-nonfermenting] (Carlson, M. et al., *Genetics*, 98:25-40 (1981)); and SNF1-related kinases in plants. The kinases are "heterotrimeric", thus requiring a complex of three protein subunits (i.e., α, β and γ) to form a functional enzyme.

The term "gene regulatory network" generically refers to a collection of DNA segments in a cell which interact with each other and with other substances in the cell, thereby governing the rates at which genes in the network are transcribed into mRNA; often, these networks feature multiple tiers of regulation, with first-tier gene products regulating expression of another group of genes, and so on. For the purposes herein, the term "heterotrimeric SNF1 protein kinase network" refers to a gene regulatory network that includes the heterotrimeric SNF1 protein kinase. Thus, this network includes upstream regulatory proteins associated with the heterotrimeric SNF1 protein kinase, all subunits encoding the heterotrimeric SNF1 protein kinase and downstream proteins regulated by the heterotrimeric SNF1 protein kinase.

The term "serine/threonine protein kinase" refers to a kinase having the ability to phosphorylate the —OH group of serine or threonine (EC 2.7.11.1). While serine/threonine protein kinases all phosphorylate serine or threonine residues in their substrates, they select specific residues to phosphorylate on the basis of residues that flank the phosphoacceptor site, which together comprise a consensus sequence. Usually, the consensus sequence residues of the substrate to be phosphorylated make contact with the catalytic cleft of the kinase at several key amino acids (usually through hydrophobic forces and ionic bonds).

The term "SNF1 protein kinase" refers to a heterotrimeric serine/threonine protein kinase, comprising: 1) a catalytic Snf1 α subunit; 2) a β subunit (encoded by one to three alternate proteins, depending on the species [e.g., *Saccharomyces cerevisiae* has three alternate β subunits identified as Sip1, Sip2 and Gal83; *Candida albicans* (and likely *Yarrowia lipolytica*) each have two β subunits; and, *Kluyveromyces lactis* and *Schizosaccharomyces pombe* each have a single β subunit]; and, 3) a γ subunit described as Snf4. The heterotrimeric SNF1 protein kinase is activated by phosphorylation in response to glucose limitation or other environmental stresses (e.g., nitrogen limitation, sodium ion stress, alkaline pH, oxidative stress). Each of the protein subunits comprises various regions of sequence conservation, corresponding to specific conserved domains that facilitate subunit interaction and/or function of the heterotrimer (reviewed by Hedbackter, K. and M. Carlson, *Frontiers in Bioscience*, 13:2408-2420 (2008)).

The term "Snf1" refers to the α subunit of the SNF1 protein kinase, encoded by the SNF1 gene. This subunit comprises an N-terminal kinase domain and a C-terminal regulatory region that interacts with Snf4 and the kinase domain (reviewed by Hedbackter, K. and M. Carlson, *Frontiers in Bioscience*, 13:2408-2420 (2008)). Activation of the Snf1 catalytic subunit requires phosphorylation of the threonine residue between conserved Asp-Phe-Gly ["DFG"] and Ala-Pro-Glu ["APE"] motifs within the N-terminal activation-loop segment of the catalytic kinase domain (Estruch, F., et al., *Genetics*, 132:639-650 (1992); McCartney, R. R. and M. C. Schmidt, *J. Biol. Chem.*, 276(39):36460-36466 (2001)).

The term "upstream regulatory protein associated with the heterotrimeric SNF1 protein kinase" refers to a variety of proteins whose function in the heterotrimeric SNF1 protein kinase network is upstream of the SNF1 protein kinase itself. Thus, upstream regulatory proteins include, for example, a kinase such as Sak1, Tos3 and Elm1, a hexokinase such as hexokinase isoenzyme 1 (Hxk1) and hexokinase isoenzyme 2 (Hxk2), a glucokinase such as Glk1, and a protein of the Reg1-Glc7 phosphatase complex, such as Reg1 and Glc7.

The term "downstream protein regulated by the heterotrimeric SNF1 protein kinase" refers to a variety of proteins whose function in the heterotrimeric SNF1 protein kinase network is downstream of the SNF1 protein kinase itself. Thus, downstream proteins within the heterotrimeric SNF1 protein kinase network of *Yarrowia lipolytica* include, for example, zinc-finger proteins such as Rme1 and Mhy1, a glucose transporter such as Snf3, a microsomal cytochrome $b_5$ reductase such as Cbr1 and other proteins that are regulated by phosphorylation by the heterotrimeric SNF1 protein kinase, such as acetyl-CoA carboxylase ["ACC"] and diacylglycerol acyltransferase ["DGAT"].

The term "bio-diesel fuel" or "biodiesel" refers to a clean burning alternative fuel, produced from domestic, renewable resources. More specifically, biodiesel is defined as monoalkyl esters of long chain fatty acids derived from vegetable oils or animal fats (most typically plant oils primarily composed of triacylglycerol lipids) which conform to ASTM D6751 specifications for use in diesel engines. Biodiesel refers to the pure fuel before blending with diesel fuel. Biodiesel blends are denoted as, "BXX" with "XX" representing the percentage of biodiesel contained in the blend. For example, B20 is a blend of 20 percent by volume biodiesel with 80 percent by volume petroleum diesel. Biodiesel can be used in compression-ignition (diesel) engines with little or no modifications. Biodiesel is simple to use, biodegradable, non-toxic, and essentially free of sulfur and aromatics.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

The term "reduced activity" in or in connection with a heterotrimeric SNF1 protein kinase refers to down-regulation, whether partial or total, of the kinase activity of the heterotrimeric SNF1 protein kinase complex comprising the α-, β-, or γ-subunit, as compared to the activity of the wild-type heterotrimeric SNF1 protein kinase. Down-regulation typically occurs when a native gene encoding the α-, β-, or γ-subunit has a "disruption" or "modification", referring to an insertion, deletion, or targeted mutation within a portion of that gene, that results in e.g., a complete gene knockout such that the gene is deleted from the genome and no protein is translated or a translated subunit protein having an insertion, deletion, amino acid substitution or other targeted mutation. The location of the modification in the protein may be, for example, within the N-terminal portion of the protein [for example, in the N-terminal activation-loop segment of Snf1] or within the C-terminal portion of the protein. The modified subunit protein will have impaired activity with respect to the α-, β-, or γ-subunit protein that was not disrupted, and can be non-functional. Reduced activity in the heterotrimeric SNF1 protein kinase could also result via manipulating the upstream regulatory proteins or regulatory domains, altering a downstream protein regulated by the heterotrimeric SNF1 protein kinase, transcription and translation factors and/or signal transduction pathways or by use of sense, antisense or RNAi technology, etc.

The term "amino acid" will refer to the basic chemical structural unit of a protein or polypeptide. The amino acids are identified by either the one-letter code or the three-letter codes for amino acids, in conformity with the IUPAC-IYUB standards described in *Nucleic Acids Research*, 13:3021-3030 (1985) and in the *Biochemical Journal*, 219 (2):345-373 (1984), which are hereby incorporated herein by reference.

The term "conservative amino acid substitution" refers to a substitution of an amino acid residue in a given protein with another amino acid, without altering the chemical or functional nature of that protein. For example, it is well known in the art that alterations in a gene that result in the production of a chemically equivalent amino acid at a given site, but which do not affect the structural and functional properties of the encoded, folded protein, are common. For the purposes of the present invention, "conservative amino acid substitutions" are defined as exchanges within one of the following five groups:

1. Small aliphatic, nonpolar or slightly polar residues: Ala [A], Ser [S], Thr [T] (Pro [P], Gly [G]);
2. Polar, negatively charged residues and their amides: Asp [D], Asn [N], Glu [E], Gln [Q];
3. Polar, positively charged residues: His [H], Arg [R], Lys [K];
4. Large aliphatic, nonpolar residues: Met [M], Leu [L], Ile [I], Val [V] (Cys [C]); and
5. Large aromatic residues: Phe [F], Tyr [Y], Trp [W].

Thus, Ala, a slightly hydrophobic amino acid, may be substituted by another less hydrophobic residue (e.g., Gly). Similarly, changes which result in substitution of one negatively charged residue for another (e.g., Asp for Glu) or one positively charged residue for another (e.g., Lys for Arg) can also be expected to produce a functionally equivalent product. As such, conservative amino acid substitutions generally maintain: 1) the structure of the polypeptide backbone in the area of the substitution; 2) the charge or hydrophobicity of the molecule at the target site; or 3) the bulk of the side chain. Additionally, in many cases, alterations of the N-terminal and C-terminal portions of the protein molecule would also not be expected to alter the activity of the protein.

The term "non-conservative amino acid substitution" refers to an amino acid substitution that is generally expected to produce the greatest change in protein properties. Thus, for example, a non-conservative amino acid substitution would be one whereby: 1) a hydrophilic residue is substituted for/by a hydrophobic residue (e.g., Ser or Thr for/by Leu, Ile, Val); 2) a Cys or Pro is substituted for/by any other residue; 3) a residue having an electropositive side chain is substituted for/by an electronegative residue (e.g., Lys, Arg or His for/by Asp or Glu); or, 4) a residue having a bulky side chain is substituted for/by one not having a side chain, e.g., Phe for/by Gly. Sometimes, non-conservative amino acid substitutions between two of the five groups will not affect the activity of the encoded protein.

The term "lipids" refer to any fat-soluble (i.e., lipophilic), naturally-occurring molecule. Lipids are a diverse group of compounds that have many key biological functions, such as structural components of cell membranes, energy storage sources and intermediates in signaling pathways. Lipids may be broadly defined as hydrophobic or amphiphilic small molecules that originate entirely or in part from either ketoacyl or isoprene groups. For a general overview of all lipid classes, refer to the Lipid Metabolites and Pathways Strategy (LIPID MAPS) classification system (National Institute of General Medical Sciences, Bethesda, Md.).

The term "oil" refers to a lipid substance that is liquid at 25° C. and usually polyunsaturated. In oleaginous organisms, oil constitutes a major part of the total lipid. "Oil" is composed primarily of triacylglycerols ["TAGs"] but may also contain other neutral lipids, phospholipids and free fatty acids. The fatty acid composition in the oil and the fatty acid composition of the total lipid are generally similar; thus, an increase or decrease in the concentration of PUFAs in the total lipid will correspond with an increase or decrease in the concentration of PUFAs in the oil, and vice versa.

"Neutral lipids" refer to those lipids commonly found in cells in lipid bodies as storage fats and are so called because at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or triacylglycerol, respectively, or collectively, acylglycerols. A hydrolysis reaction must occur to release free fatty acids from acylglycerols.

The term "triacylglycerols" ["TAGs"] refers to neutral lipids composed of three fatty acyl residues esterified to a glycerol molecule. TAGs can contain long chain PUFAs and saturated fatty acids, as well as shorter chain saturated and unsaturated fatty acids.

The term "total fatty acids" ["TFAs"] herein refer to the sum of all cellular fatty acids that can be derivitized to fatty acid methyl esters ["FAMEs"] by the base transesterification method (as known in the art) in a given sample, which may be the biomass or oil, for example. Thus, total fatty acids include fatty acids from neutral lipid fractions (including diacylglycerols, monoacylglycerols and TAGs) and from polar lipid fractions (including the phosphatidylcholine ["PC"] and phosphatidylethanolamine ["PE"] fractions) but not free fatty acids.

The term "total lipid content" of cells is a measure of TFAs as a percent of the dry cell weight ["DCW"], although total lipid content can be approximated as a measure of FAMEs as a percent of the DCW ["FAMEs % DCW"]. Thus, total lipid content ["TFAs % DCW"] is equivalent to, e.g., milligrams of total fatty acids per 100 milligrams of DCW.

The concentration of a fatty acid in the total lipid is expressed herein as a weight percent of TFAs ["% TFAs"], e.g., milligrams of the given fatty acid per 100 milligrams of TFAs. Unless otherwise specifically stated in the disclosure herein, reference to the percent of a given fatty acid with respect to total lipids is equivalent to concentration of the fatty acid as % TFAs (e.g., % EPA of total lipids is equivalent to EPA % TFAs).

In some cases, it is useful to express the content of a given fatty acid(s) in a cell as its weight percent of the dry cell weight ["% DCW"]. Thus, for example, eicosapentaenoic acid % DCW would be determined according to the following formula: [(eicosapentaenoic acid % TFAs)*(TFAs % DCW)]/100. The content of a given fatty acid(s) in a cell as its weight percent of the dry cell weight ["% DCW"] can be approximated, however, as: [(eicosapentaenoic acid % TFAs)*(FAMEs % DCW)]/100.

The terms "lipid profile" and "lipid composition" are interchangeable and refer to the amount of individual fatty acids contained in a particular lipid fraction, such as in the total lipid or the oil, wherein the amount is expressed as a weight percent of TFAs. The sum of each individual fatty acid present in the mixture should be 100.

The term "extracted oil" refers to an oil that has been separated from other cellular materials, such as the microorganism in which the oil was synthesized. Extracted oils are obtained through a wide variety of methods, the simplest of which involves physical means alone. For example, mechanical crushing using various press configurations (e.g., screw, expeller, piston, bead beaters, etc.) can separate oil from cellular materials. Alternately, oil extraction can occur via treatment with various organic solvents (e.g., hexane), via enzymatic extraction, via osmotic shock, via ultrasonic extraction, via supercritical fluid extraction (e.g., $CO_2$ extraction), via saponification and via combinations of these methods. An extracted oil does not require that it is not necessarily purified or further concentrated.

The term "fatty acids" refers to long chain aliphatic acids (alkanoic acids) of varying chain lengths, from about $C_{12}$ to $C_{22}$, although both longer and shorter chain-length acids are known. The predominant chain lengths are between $C_{16}$ and $C_{22}$. The structure of a fatty acid is represented by a simple notation system of "X:Y", where X is the total number of carbon ["C"] atoms in the particular fatty acid and Y is the number of double bonds. Generally, fatty acids are classified as saturated or unsaturated. The term "saturated fatty acids" refers to those fatty acids that have no "double bonds" between their carbon backbone. In contrast, "unsaturated fatty acids" are cis-isomers that have "double bonds" along their carbon backbones. Additional details concerning the differentiation between "monounsaturated fatty acids" versus "polyunsaturated fatty acids" ["PUFAs"], and "omega-6 fatty acids" ["ω-6" or "n-6"] versus "omega-3 fatty acids" ["ω-3"] or ["n-3"] are provided in U.S. Pat. No. 7,238,482, which is hereby incorporated herein by reference.

Nomenclature used to describe PUFAs herein is given in Table 2. In the column titled "Shorthand Notation", the omega-reference system is used to indicate the number of carbons, the number of double bonds and the position of the double bond closest to the omega carbon, counting from the omega carbon (which is numbered 1 for this purpose). The remainder of the Table summarizes the common names of ω-3 and ω-6 fatty acids and their precursors, the abbreviations that will be used throughout the specification and the chemical name of each compound.

TABLE 2

Nomenclature of Polyunsaturated Fatty Acids And Precursors

| Common Name | Abbreviation | Chemical Name | Shorthand Notation |
|---|---|---|---|
| Myristic | — | tetradecanoic | 14:0 |
| Palmitic | Palmitate | hexadecanoic | 16:0 |
| Palmitoleic | — | 9-hexadecenoic | 16:1 |
| Stearic | — | octadecanoic | 18:0 |
| Oleic | — | cis-9-octadecenoic | 18:1 |
| Linoleic | LA | cis-9,12-octadecadienoic | 18:2 ω-6 |
| γ-Linolenic | GLA | cis-6,9,12-octadecatrienoic | 18:3 ω-6 |
| Eicosadienoic | EDA | cis-11,14-eicosadienoic | 20:2 ω-6 |
| Dihomo-γ-Linolenic | DGLA | cis-8,11,14-eicosatrienoic | 20:3 ω-6 |
| Arachidonic | ARA | cis-5,8,11,14-eicosatetraenoic | 20:4 ω-6 |
| α-Linolenic | ALA | cis-9,12,15-octadecatrienoic | 18:3 ω-3 |
| Stearidonic | STA | cis-6,9,12,15-octadecatetraenoic | 18:4 ω-3 |
| Eicosatrienoic | ETrA | cis-11,14,17-eicosatrienoic | 20:3 ω-3 |
| Sciadonic | SCI | cis-5,11,14-eicosatrienoic | 20:3b ω-6 |
| Juniperonic | JUP | cis-5,11,14,17-eicosatetraenoic | 20:4b ω-3 |
| Eicosa-tetraenoic | ETA | cis-8,11,14,17-eicosatetraenoic | 20:4 ω-3 |
| Eicosa-pentaenoic | EPA | cis-5,8,11,14,17-eicosapentaenoic | 20:5 ω-3 |
| Docosa-trienoic | DRA | cis-10,13,16-docosatrienoic | 22:3 ω-3 |
| Docosa-tetraenoic | DTA | cis-7,10,13,16-docosatetraenoic | 22:4 ω-3 |
| Docosa-pentaenoic | DPAn-6 | cis-4,7,10,13,16-docosapentaenoic | 22:5 ω-6 |
| Docosa-pentaenoic | DPA | cis-7,10,13,16,19-docosapentaenoic | 22:5 ω-3 |

TABLE 2-continued

Nomenclature of Polyunsaturated Fatty Acids And Precursors

| Common Name | Abbreviation | Chemical Name | Shorthand Notation |
|---|---|---|---|
| Docosa-hexaenoic | DHA | cis-4,7,10,13,16,19-docosahexaenoic | 22:6 ω-3 |

Although the ω-3/ω-6 PUFAs listed in Table 2 are the most likely to be accumulated in the oil fractions of oleaginous yeast using the methods described herein, this list should not be construed as limiting or as complete.

The term "oleaginous" refers to those organisms that tend to store their energy source in the form of oil (Weete, In: Fungal Lipid Biochemistry, $2^{nd}$ Ed., Plenum, 1980).

The term "oleaginous yeast" refers to those microorganisms classified as yeasts that can make oil. Generally, the cellular oil content of oleaginous microorganisms follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.*, 57:419-25 (1991)). It is common for oleaginous microorganisms to accumulate in excess of about 25% of their dry cell weight as oil. Examples of oleaginous yeast include, but are no means limited to, the following genera: *Yarrowia, Candida, Rhodotorula, Rhodosporidium, Cryptococcus, Trichosporon* and *Lipomyces*.

The term "PUFA biosynthetic pathway" refers to a metabolic process that converts oleic acid to ω-6 fatty acids such as LA, EDA, GLA, DGLA, ARA, DRA, DTA and DPAn-6 and ω-3 fatty acids such as ALA, STA, ETrA, ETA, EPA, DPA and DHA. This process is well described in the literature. See e.g., Intl. App. Pub. No. WO 2006/052870. Briefly, this process involves elongation of the carbon chain through the addition of carbon atoms and desaturation of the molecule through the addition of double bonds, via a series of special desaturation and elongation enzymes termed "PUFA biosynthetic pathway enzymes" that are present in the endoplasmic reticulum membrane. More specifically, "PUFA biosynthetic pathway enzymes" refer to any of the following enzymes (and genes which encode said enzymes) associated with the biosynthesis of a PUFA, including: Δ4 desaturase, Δ5 desaturase, Δ6 desaturase, Δ12 desaturase, Δ15 desaturase, Δ17 desaturase, Δ9 desaturase, Δ8 desaturase, Δ9 elongase, $C_{14/16}$ elongase, $C_{16/18}$ elongase, $C_{18/20}$ elongase and/or $C_{20/22}$ elongase.

The term "desaturase" refers to a polypeptide that can desaturate, i.e., introduce a double bond, in one or more fatty acids to produce a fatty acid or precursor of interest. Despite use of the omega-reference system throughout the specification to refer to specific fatty acids, it is more convenient to indicate the activity of a desaturase by counting from the carboxyl end of the substrate using the delta-system. Of particular interest herein are: Δ8 desaturases, Δ5 desaturases, Δ7 desaturases, Δ12 desaturases, Δ4 desaturases, Δ6 desaturases, Δ15 desaturases and Δ9 desaturases. In the art, Δ15 and Δ17 desaturases are also occasionally referred to as "omega-3 desaturases", "w-3 desaturases", and/or "ω-3 desaturases", based on their ability to convert ω-6 fatty acids into their ω-3 counterparts (e.g., conversion of LA into ALA and ARA into EPA, respectively). It may be desirable to empirically determine the specificity of a particular fatty acid desaturase by transforming a suitable host with the gene for the fatty acid desaturase and determining its effect on the fatty acid profile of the host.

The term "elongase" refers to a polypeptide that can elongate a fatty acid carbon chain to produce an acid 2 carbons longer than the fatty acid substrate that the elongase acts upon. This process of elongation occurs in a multi-step mechanism in association with fatty acid synthase, as described in U.S. Pat. App. Pub. No. 2005/0132442 and Intl. App. Pub. No. WO 2005/047480. Examples of reactions catalyzed by elongase systems are the conversion of GLA to DGLA, STA to ETA and EPA to DPA. In general, the substrate selectivity of elongases is somewhat broad but segregated by both chain length and the degree and type of unsaturation. For example, a $C_{14/16}$ elongase will utilize a $C_{14}$ substrate e.g., myristic acid, a $C_{16/18}$ elongase will utilize a $C_{16}$ substrate e.g., palmitate, a $C_{18/20}$ elongase will utilize a $C_{18}$ substrate (e.g., GLA, STA, LA, ALA) and a $C_{20/22}$ elongase [also referred to as a Δ5 elongase] will utilize a $C_{20}$ substrate (e.g., ARA, EPA). For the purposes herein, two distinct types of $C_{18/20}$ elongases can be defined: a Δ6 elongase will catalyze conversion of GLA and STA to DGLA and ETA, respectively, while a Δ9 elongase is able to catalyze the conversion of LA and ALA to EDA and ETrA, respectively.

It is important to note that some elongases have broad specificity and thus a single enzyme may be capable of catalyzing several elongase reactions e.g., thereby acting as both a $C_{16/18}$ elongase and a $C_{18/20}$ elongase. It may be desirable to empirically determine the specificity of a fatty acid elongase by transforming a suitable host with the gene for the fatty acid elongase and determining its effect on the fatty acid profile of the host.

The terms "conversion efficiency" and "percent substrate conversion" refer to the efficiency by which a particular enzyme, such as, a desaturase, can convert substrate to product. The conversion efficiency is measured according to the following formula: ([product]/[substrate+product])*100, where 'product' includes the immediate product and all products in the pathway derived from it.

The terms "polynucleotide", "polynucleotide sequence", "nucleic acid sequence", "nucleic acid fragment" and "isolated nucleic acid fragment" are used interchangeably herein. These terms encompass nucleotide sequences and the like. A polynucleotide may be a polymer of RNA or DNA that is single- or double-stranded, that optionally contains synthetic, non-natural or altered nucleotide bases. A polynucleotide in the form of a polymer of DNA may be comprised of one or more segments of cDNA, genomic DNA, synthetic DNA, or mixtures thereof. Nucleotides (usually found in their 5'-monophosphate form) are referred to by a single letter designation as follows: "A" for adenylate or deoxyadenylate (for RNA or DNA, respectively), "C" for cytidylate or deoxycytidylate, "G" for guanylate or deoxyguanylate, "U" for uridylate, "T" for deoxythymidylate, "R" for purines (A or G), "Y" for pyrimidines (C or T), "K" for G or T, "H" for A or C or T, "I" for inosine, and "N" for any nucleotide.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual, $2^{nd}$* ed., Cold Spring Harbor Laboratory: Cold Spring Harbor, N.Y. (1989), which is hereby incorporated herein by reference, particularly Chapter 11 and Table 11.1. The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability, corresponding to higher Tm, of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Basic Local Alignment Search Tool; Altschul, S. F., et al., *J. Mol. Biol.,* 215: 403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation, such as, in situ hybridization of microbial colonies or bacteriophage plaques. In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The disclosure herein teaches the complete amino acid and nucleotide sequence encoding particular proteins of the heterotrimeric SNF1 protein kinase. The skilled artisan, having the benefit of the sequences as reported herein, may now use all or a substantial portion of the disclosed sequences for purposes known to those skilled in this art. Accordingly, the complete sequences as reported in the accompanying Sequence Listing, as well as substantial portions of those sequences as defined above, are encompassed in the present disclosure.

The term "complementary" is used to describe the relationship between nucleotide bases that are capable of hybridizing to one another. For example, with respect to DNA, adenosine is complementary to thymine and cytosine is complementary to guanine. Accordingly, isolated nucleic acid fragments that are complementary to the complete sequences as reported in the accompanying Sequence Listing, as well as those substantially similar nucleic acid sequences, are encompassed in the present disclosure.

The terms "homology" and "homologous" are used interchangeably. They refer to nucleic acid fragments wherein changes in one or more nucleotide bases do not affect the ability of the nucleic acid fragment to mediate gene expression or produce a certain phenotype. These terms also refer to modifications of the nucleic acid fragments such as deletion or insertion of one or more nucleotides that do not substantially alter the functional properties of the resulting nucleic acid fragment relative to the initial, unmodified fragment.

Moreover, the skilled artisan recognizes that homologous nucleic acid sequences are also defined by their ability to hybridize, under moderately stringent conditions, such as 0.5×SSC, 0.1% SDS, 60° C., with the sequences exemplified herein, or to any portion of the nucleotide sequences disclosed herein and which are functionally equivalent thereto. Stringency conditions can be adjusted to screen for moderately similar fragments, such as homologous sequences from distantly related organisms, to highly similar fragments, such as genes that duplicate functional enzymes from closely related organisms.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have at least about 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. An additional set of stringent conditions include hybridization at 0.1×SSC, 0.1% SDS, 65° C. and washed with 2×SSC, 0.1% SDS followed by 0.1×SSC, 0.1% SDS, for example.

Specificity is typically the function of post-hybridization washes, the important factors being the ionic strength and temperature of the final wash solution. For DNA-DNA hybrids, the thermal melting point ["$T_m$"] can be approximated from the equation of Meinkoth et al., *Anal. Biochem.*, 138:267-284 (1984): $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the $T_m$ for the specific sequence and its complement at a defined ionic strength and pH. However, severely stringent conditions can utilize a hybridization and/or wash at 1, 2, 3, or 4° C. lower than the $T_m$; moderately stringent conditions can utilize a hybridization and/or wash at 6, 7, 8, 9, or 10° C. lower than the $T_m$; and, low stringency conditions can utilize a hybridization and/or wash at 11, 12, 13, 14, 15, or 20° C. lower than the $T_m$. Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution), it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, N.Y. (1993); and *Current Protocols in Molecular Biology*, Chapter 2, Ausubel et al., Eds., Greene Publishing and Wiley-Interscience, New York (1995). Hybridization and/or wash conditions can be applied for at least 10, 30, 60, 90, 120 or 240 minutes.

The term "percent identity" refers to a relationship between two or more polypeptide sequences or two or more polynucleotide sequences, as determined by comparing the sequences. "Percent identity" also means the degree of sequence relatedness between polypeptide or polynucleotide sequences, as the case may be, as determined by the percentage of match between compared sequences. "Percent identity" and "percent similarity" can be readily calculated by known methods, including but not limited to those described in: 1) *Computational Molecular Biology* (Lesk, A. M., Ed.) Oxford University: NY (1988); 2) *Biocomputing: Informatics and Genome Projects* (Smith, D. W., Ed.) Academic: NY (1993); 3) *Computer Analysis of Sequence Data, Part I* (Griffin, A. M., and Griffin, H. G., Eds.) Humania: NJ (1994); 4) *Sequence Analysis in Molecular Biology* (von Heinje, G., Ed.) Academic (1987); and, 5) *Sequence Analysis Primer* (Gribskov, M. and Devereux, J., Eds.) Stockton: NY (1991).

Preferred methods to determine percent identity are designed to give the best match between the sequences tested. Methods to determine percent identity and percent similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" and the "Clustal W method of alignment" (described by Higgins and Sharp, *CABIOS*, 5:151-153 (1989); Higgins, D. G. et al., *Comput. Appl. Biosci.*, 8:189-191 (1992)) and found in the MegAlign™ (version 8.0.2) program of the LASERGENE bioinformatics computing suite (DNASTAR Inc.). After alignment of the sequences using either Clustal program, it is possible to obtain a "percent identity" by viewing the "sequence distances" table in the program.

For multiple alignments using the Clustal V method of alignment, the default values correspond to GAP PENALTY=10 and GAP LENGTH PENALTY=10. Default parameters for pairwise alignments and calculation of percent identity of protein sequences using the Clustal V method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. Default parameters for multiple alignment using the Clustal W method of alignment correspond to GAP PENALTY=10, GAP LENGTH PENALTY=0.2, Delay Divergent Seqs (%)=30, DNA Transition Weight=0.5, Protein Weight Matrix=Gonnet Series, DNA Weight Matrix=IUB.

The "BLASTN method of alignment" is an algorithm provided by the National Center for Biotechnology Information (NCBI) to compare nucleotide sequences using default parameters, while the "BLASTP method of alignment" is an algorithm provided by the NCBI to compare protein sequences using default parameters.

It is well understood by one skilled in the art that many levels of sequence identity are useful in identifying polypeptides, from other species, wherein such polypeptides have the same or similar function or activity. Suitable nucleic acid fragments, i.e., isolated polynucleotides encoding polypeptides in the methods and host cells described herein, encode polypeptides that are at least about 70-85% identical, while more preferred nucleic acid fragments encode amino acid sequences that are at least about 85-95% identical to the amino acid sequences reported herein. Although preferred ranges are described above, useful examples of percent identities include any integer percentage from 50% to 100%, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Also, of interest is any full-length or partial complement of this isolated nucleotide fragment.

Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

"Codon degeneracy" refers to the nature in the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

"Synthetic genes" can be assembled from oligonucleotide building blocks that are chemically synthesized using procedures known to those skilled in the art. These building blocks are annealed and then ligated to form gene segments that are then enzymatically assembled to construct the entire gene. Accordingly, the genes can be tailored for optimal gene expression based on optimization of nucleotide sequence to reflect the codon bias of the host cell. The skilled artisan appreciates the likelihood of successful gene expression if codon usage is biased towards those codons favored by the host. Determination of preferred codons can be based on a survey of genes derived from the host cell, where sequence information is available. For example, the codon usage profile for *Yarrowia lipolytica* is provided in U.S. Pat. No. 7,125,672.

"Gene" refers to a nucleic acid fragment that expresses a specific protein, and which may refer to the coding region alone or may include regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene that is introduced into the host organism by gene transfer. Foreign genes can comprise native genes inserted into a non-native organism, native genes introduced into a new location within the native host, or chimeric genes. A "transgene" is a gene that has been introduced into the genome by a transformation procedure. A "codon-optimized gene" is a gene having its frequency of codon usage designed to mimic the frequency of preferred codon usage of the host cell.

"Coding sequence" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, enhancers, silencers, 5' untranslated leader sequence (e.g., between the transcription start site and the translation initiation codon), introns, polyadenylation recognition sequences, RNA processing sites, effector binding sites and stem-loop structures.

"Promoter" refers to a DNA sequence capable of controlling the expression of a coding sequence or functional RNA. In general, a coding sequence is located 3' to a promoter sequence. Promoters may be derived in their entirety from a native gene, or be composed of different elements such as enhancers and silencers derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters that cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The terms "3' non-coding sequence" and "transcription terminator" refer to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence.

"RNA transcript" refers to the product resulting from RNA polymerase-catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA. "Messenger RNA" or "mRNA" refers to the RNA that is without introns and which can be translated into protein by the cell. "cDNA" refers to a double-stranded DNA that is complementary to, and derived from, mRNA. "Sense" RNA refers to RNA transcript that includes the mRNA and so can be translated into protein by the cell. "Antisense RNA" refers to a RNA transcript that is complementary to all or part of a target primary transcript or mRNA and that blocks the expression of a target gene (U.S. Pat. No. 5,107,065; Intl App. Pub. No. WO 99/28508).

The term "operably linked" refers to the association of nucleic acid sequences on a single nucleic acid fragment so that the function of one is affected by the other. For example, a promoter is operably linked with a coding sequence when it is capable of affecting the expression of that coding sequence. That is, the coding sequence is under the transcriptional control of the promoter. Coding sequences can be operably linked to regulatory sequences in sense or antisense orientation.

The term "recombinant" refers to an artificial combination of two otherwise separated segments of sequence, e.g., by chemical synthesis or by the manipulation of isolated segments of nucleic acids by genetic engineering techniques.

The term "expression", as used herein, refers to the transcription and stable accumulation of sense (mRNA) or antisense RNA derived from nucleic acid fragments. Expression may also refer to translation of mRNA into a polypeptide. Thus, the term "expression", as used herein, also refers to the production of a functional end-product (e.g., an mRNA or a protein [either precursor or mature]).

"Transformation" refers to the transfer of a nucleic acid molecule into a host organism, resulting in genetically stable inheritance. The nucleic acid molecule may be a plasmid that replicates autonomously, for example, or, it may integrate into the genome of the host organism. Host organisms containing the transformed nucleic acid fragments are referred to as "transgenic" or "recombinant" or "transformed" or "transformant" organisms.

The terms "plasmid" and "vector" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction that is capable of introducing an expression cassette(s) into a cell.

The term "expression cassette" refers to a fragment of DNA containing a foreign gene and having elements in addition to the foreign gene that allow for enhanced expression of that gene in a foreign host. Generally, an expression cassette will comprise the coding sequence of a selected gene and regulatory sequences preceding (5' non-coding sequences) and following (3' non-coding sequences) the coding sequence that are required for expression of the selected gene product. Thus, an expression cassette is typically composed of: 1) a promoter sequence; 2) a coding sequence ["ORF"]; and 3) a 3' untranslated region, i.e., a terminator that in eukaryotes usually contains a polyadenylation site. The expression cassette(s) is usually included within a vector, to facilitate cloning and transformation. Different expression cassettes can be transformed into different organisms including bacteria, yeast, plants and mammalian cells, as long as the correct regulatory sequences are used for each host.

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a recombinant DNA construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments described herein. The skilled artisan will also recognize that different independent transformation events will result in different levels and patterns of expression (Jones et al., EMBO J., 4:2411-2418 (1985); De Almeida et al., Mol. Gen. Genetics, 218:78-86 (1989)), and thus that multiple events must be screened in order to obtain lines displaying the desired expression level and pattern.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1) the GCG suite of programs (Wisconsin Package Version 9.0, Genetics Computer Group (GCG), Madison, Wis.); 2) BLASTP, BLASTN, BLASTX (Altschul et al., J. Mol. Biol., 215:403-410 (1990)); 3) DNASTAR (DNASTAR, Inc. Madison, Wis.); 4) Sequencher (Gene Codes Corporation, Ann Arbor, Mich.); and, 5) the FASTA program incorporating the Smith-Waterman algorithm (W. R. Pearson, Comput. Methods Genome Res., [Proc. Int. Symp.] (1994), Meeting Date 1992, 111-20. Editor(s): Suhai, Sandor. Plenum: New York, N.Y.). Within this description, whenever sequence analysis software is used for analysis, the analytical results are based on the "default values" of the program referenced, unless otherwise specified. As used herein "default values" will mean any set of values or parameters that originally load with the software when first initialized.

Standard recombinant DNA and molecular cloning techniques used herein are well known in the art and are described by Sambrook, J., Fritsch, E. F. and Maniatis, T., Molecular Cloning: A Laboratory Manual, $2^{nd}$ ed., Cold Spring Harbor Laboratory: Cold Spring Harbor, N.Y. (1989) (hereinafter "Maniatis"); by Silhavy, T. J., Bennan, M. L. and Enquist, L. W., Experiments with Gene Fusions, Cold Spring Harbor Laboratory: Cold Spring Harbor, N.Y. (1984); and by Ausubel, F. M. et al., Current Protocols in Molecular Biology, published by Greene Publishing Assoc. and Wiley-Interscience, Hoboken, N.J. (1987).

In general, lipid accumulation in oleaginous microorganisms is triggered in response to the overall carbon to nitrogen ratio present in the growth medium. This process, leading to the de novo synthesis of free palmitate (16:0) in oleaginous microorganisms, is described in detail in U.S. Pat. No. 7,238,482. Palmitate is the precursor of longer-chain saturated and unsaturated fatty acid derivates, which are formed through the action of elongases and desaturases (FIG. 2).

A wide spectrum of fatty acids (including saturated and unsaturated fatty acids and short-chain and long-chain fatty acids) can be incorporated into TAGs, the primary storage unit for fatty acids. In the methods and host cells described herein, incorporation of "long-chain" PUFAs ["LC-PUFAs"] into TAGs is most desirable, wherein LC-PUFAs include any fatty acid derived from an 18:1 substrate having at least 18 carbons in length, i.e., $C_{18}$ or greater. The structural form of the LC-PUFA is not limiting (thus, for example, the LC-PUFAs may exist in the total lipids as free fatty acids or in esterified forms such as acylglycerols, phospholipids, sulfolipids or glycolipids). This also includes hydroxylated fatty acids, expoxy fatty acids and conjugated linoleic acid.

Although most PUFAs are incorporated into TAGs as neutral lipids and are stored in lipid bodies, it is important to note that a measurement of the total PUFAs within an oleaginous organism should minimally include those PUFAs that are located in the PC, PE and TAG fractions.

The metabolic process wherein oleic acid is converted to ω-3/ω-6 fatty acids involves elongation of the carbon chain through the addition of carbon atoms and desaturation of the molecule through the addition of double bonds. This requires a series of special desaturation and elongation enzymes present in the endoplasmic reticulum membrane. However, as seen in FIG. 2 and as described below, multiple alternate pathways exist for production of a specific ω-3/ω-6 fatty acid.

Specifically, FIG. 2 depicts the pathways described below. All pathways require the initial conversion of oleic acid to linoleic acid ["LA"], the first of the ω-6 fatty acids, by a Δ12 desaturase. Then, using the "Δ9 elongase/Δ8 desaturase pathway" and LA as substrate, long-chain ω-6 fatty acids are formed as follows: 1) LA is converted to eicosadienoic acid ["EDA"] by a Δ9 elongase; 2) EDA is converted to dihomo-γ-linolenic acid ["DGLA"] by a Δ8 desaturase; 3) DGLA is converted to arachidonic acid ["ARA"] by a Δ5 desaturase; 4) ARA is converted to docosatetraenoic acid ["DTA"] by a $C_{20/22}$ elongase; and, 5) DTA is converted to docosapentaenoic acid ["DPAn-6"] by a Δ4 desaturase.

The "Δ9 elongase/Δ8 desaturase pathway" can also use α-linolenic acid ["ALA"] as substrate to produce long-chain ω-3 fatty acids as follows: 1) LA is converted to ALA, the first of the ω-3 fatty acids, by a Δ15 desaturase; 2) ALA is converted to eicosatrienoic acid ["ETrA"] by a Δ9 elongase; 3) ETrA is converted to eicosatetraenoic acid ["ETA"] by a Δ8 desaturase; 4) ETA is converted to eicosapentaenoic acid ["EPA"] by a Δ5 desaturase; 5) EPA is converted to docosapentaenoic acid ["DPA"] by a $C_{20/22}$ elongase; and, 6) DPA is converted to docosahexaenoic acid ["DHA"] by a Δ4 desaturase. Optionally, ω-6 fatty acids may be converted to ω-3 fatty acids. For example, ETA and EPA are produced from DGLA and ARA, respectively, by Δ17 desaturase activity. Advantageously for the purposes herein, the Δ9 elongase/Δ8 desaturase pathway enables production of an EPA oil that lacks significant amounts of γ-linolenic acid ["GLA"].

Alternate pathways for the biosynthesis of ω-3/ω-6 fatty acids utilize a Δ6 desaturase and $C_{18/20}$ elongase, that is, the "Δ6 desaturase/Δ6 elongase pathway". More specifically, LA and ALA may be converted to GLA and stearidonic acid ["STA"], respectively, by a Δ6 desaturase; then, a $C_{18/20}$ elongase converts GLA to DGLA and/or STA to ETA.

The host organism of the invention may optionally possess the ability to produce PUFAs, either naturally or via techniques of genetic engineering. Specifically, although many microorganisms can synthesize PUFAs (including ω-3/ω-6 fatty acids) in the ordinary course of cellular metabolism, some of whom could be commercially cultured, few to none of these organisms produce oils having a desired oil content and composition for use as pharmaceuticals, dietary substitutes, medical foods, nutritional supplements, other food products, industrial oleochemicals or other end-use applications. Thus, there is increasing emphasis on the ability to engineer microorganisms for production of "designer" lipids and oils, wherein the fatty acid content and composition are carefully specified by genetic engineering. It is expected that the host will likely comprise heterologous genes encoding a functional PUFA biosynthetic pathway but not necessarily.

If the host organism does not natively produce the desired PUFAs or possess the desired lipid profile, one skilled in the art will be familiar with the considerations and techniques necessary to introduce one or more expression cassettes encoding appropriate enzymes for PUFA biosynthesis into the host organism of choice, e.g., expression cassettes encoding Δ8 desaturases, Δ5 desaturases, Δ17 desaturases, Δ12 desaturases, Δ4 desaturases, Δ6 desaturases, Δ15 desaturases, Δ9 desaturases, $C_{14/16}$ elongases, $C_{16/18}$ elongases, $C_{18/20}$ elongases and/or $C_{20/22}$ elongases (FIG. 2). Numerous teachings are provided in the literature to one of skill in the art for identifying and evaluating the suitability of various candidate genes encoding each of the enzymes desired for ω-3/ω-6 fatty acid biosynthesis, and so introducing such expression cassettes into various host organisms. Of course, the particular genes included within a particular expression cassette will depend on the host organism, its PUFA profile and/or desaturase/elongase profile, the availability of substrate and the desired end product(s). Some references using the host organism Yarrowia lipolytica are provided as follows: U.S. Pat. No. 7,238,482; U.S. Pat. No. 7,465,564; U.S. Pat. App. Pub. No. US-2006-0094092; U.S. Pat. App. Pub. No. US-2006-0115881-A1; U.S. Pat. App. Pub. No. US-2006-0110806-A1; and U.S. Pat. App. Pub. No. US-2009-0093543-A1. This list is not exhaustive and should not be construed as limiting.

Preferably, the oleaginous eukaryotic host cell will be capable of producing at least about 2-5% LC-PUFAs in the total lipids of the host cell, more preferably at least about 5-15% LC-PUFAs in the total lipids, more preferably at least about 15-35% LC-PUFAs in the total lipids, more preferably at least about 35-50% LC-PUFAs in the total lipids, more preferably at least about 50-65% LC-PUFAs in the total lipids and most preferably at least about 65-75% LC-PUFAs in the total lipids. The structural form of the LC-PUFAs is not limiting; thus, for example, the EPA or DHA may exist in the total lipids as free fatty acids or in esterified forms such as acylglycerols, phospholipids, sulfolipids or glycolipids.

A number of reviews have described the AMPK/SNF1 protein kinase family and current understanding of the structure and function of the protein as a global regulator. See, for example, Hardie, D. G. et al., "The AMP-Activated/SNF1 Protein Kinase Subfamily: Metabolic Sensors of the Eukaryotic Cell?", *Annu. Rev. Biochem.*, 67:821-855 (1998) and Hedbacker, K. and M. Carlson, "SNF1/AMPK Pathways in Yeast", *Frontiers in Bioscience*, 13:2408-2420 (2008). As described in Hedbacker and Carlson (supra), the heterotrimeric SNF1 protein kinase of *Saccharomyces cerevisiae* is required for the cell to adapt to glucose limitation and to utilize alternate carbon sources that are less preferred than glucose, such as sucrose, galactose, ethanol. The kinase has additional roles in various other cellular responses to nutrient and environmental stresses. SNF1 protein kinase regulates the transcription of numerous glucose-repressed genes, with a significant portion of those genes functioning in transcription and signal transduction. In general, when the heterotrimeric kinase is activated by phosphorylation, for example, in response to glucose limitation, ATP-producing catabolic pathways increase. That is, respiration, glyconeogenesis and β-oxidation are up-regulated, while expression of many other glucose-repressed genes is increased and ATP-consuming anabolic pathways decrease, that is, fatty acid synthesis and glycogen metabolism are down-regulated through complex enzyme cascade reactions.

As with any biological system, the activity of the heterotrimeric SNF1 protein kinase is tightly controlled by several upstream regulatory proteins, to ensure that its level of activity is appropriately regulated. Together, these upstream regulatory proteins, the subunits of the heterotrimeric SNF1 protein kinase, and the downstream proteins that are regulated by the heterotrimeric SNF1 protein kinase are referred to as the SNF1 protein kinase network.

The complex interplay between proteins within the SNF1 protein kinase network will likely never be fully understood. For example, Young, E. T., et al. (*J. Biol. Chem.*, 278:26146 (2003)) found over 400 *S. cerevisiae* genes were SNF1-dependent under glucose limitation, based on genomic expression studies and microarray analysis. Based on microarray analysis in *Yarrowia lipolytica*, it has been determined that over 200 genes are differentially expressed by more than 1.3-fold in snf1Δ strains, when compared to their expression in control strains (Example 11, Table 25).

A summary of the regulation of the heterotrimeric SNF1 protein kinase is schematically diagrammed in FIG. 1, based on the experimentation described in the present application as well as from various other publications. In brief, both the inactive (left) and active (right) heterotrimeric SNF1 protein kinase is composed of a catalytic subunit Snf1, a regulatory subunit Snf4, and a bridging β-subunit (i.e., encoded by Sip1, Sip2 and/or Gal83). Snf1 itself is composed of a catalytic kinase domain ["KD"] that renders its kinase activity and a regulatory domain ["RD"] that interacts with Snf4, the Snf1 KD, and the β-subunit. Activation of the heterotrimeric SNF1 protein kinase requires phosphorylation of the threonine at the activation-loop segment of Snf1 KD. Down-regulation of the expression of any of the genes encoding Snf1, Snf4 or the β-subunit will therefore alter the functionality of the heterotrimeric SNF1 protein kinase.

Upstream regulatory proteins associated with the heterotrimeric SNF1 protein kinase include various Ser/Thr kinases (e.g., Sak1, Tos3 and Elm1), hexokinases (e.g., Hxk2), and proteins of the protein-phosphatase 1 complex (e.g., Reg1 and Glc7). The extent of heterotrimeric SNF1 protein kinase activation appears to be regulated by expression of the Sak1, Tos3 and/or Elm1 kinases, while the degree of heterotrimeric SNF1 protein kinase inactivation appears to be manipulated by expression of Hxk2, Glk1, Reg1 and Glc7.

When the heterotrimeric SNF1 protein kinase is inactive, a variety of downstream proteins are affected. For example, transcription factors such as zinc-finger proteins (e.g., Rme1, Mhy1), microsomal cytochrome $b_5$ reductase proteins (e.g., Cbr1) and glucose transporters (e.g., Snf3) are up-regulated. In contrast, when the heterotrimeric SNF1 protein kinase is active, various proteins whose activity is modulated by phosphorylation (e.g., acetyl-CoA carboxylase ["ACC"] and diacylglycerol acyltransferases ["DGATs"]) can become inactivated.

It has been discovered that reduction in the activity of the heterotrimeric SNF1 protein kinase results in increased total lipid content (measured as TFAs % DCW) within transgenic oleaginous eukaryotic host cells, such as in the yeast *Yarrowia lipolytica*. This reduction in the activity of the heterotrimeric SNF1 protein kinase can be achieved via: 1) down-regulation of Sak1 and Tos3; 2) up-regulation of Hxk2, Glk1 or Reg1; 3) down-regulation of Snf1, Snf4, Sip2 or Gal83; 4) up-regulation of the Snf1 regulatory domain; 4) up-regulation of a catalytically inactive variant of Snf1; 6) up-regulation of Rme1, Cbr1 or Snf3; and 7) up-regulation of a mutant variant of ACC or DGAT, wherein said mutant variant can not be phosphorylated by the heterotrimeric SNF1 protein kinase. Details concerning each of these mechanisms to regulate the activity of the heterotrimeric SNF1 protein kinase will be discussed below.

Glucose repression in *Saccharomyces cerevisiae* is known to be tightly regulated by complex metabolic pathway. As part of this pathway, the heterotrimeric SNF1 protein kinase can be activated by any one of three upstream kinases, Sak1, Tos3 or Elm1. All three Snf1-activating kinases contain serine/threonine kinase domains near their N-termini and large C-terminal domains with little sequence conservation. The pathway specificity of these kinases, based on the creation of a series of deletion mutants, has recently been studied by Rubenstein, E. M., et al. (*Eukaryot Cell.*, 5(4):620-627 (2006)). It is demonstrated herein that SNF1 protein kinase activity is decreased by disrupting Sak1 in a manner suitable to inhibit the activity of that kinase.

Another major component of the glucose repression pathway as surmised by its role in regulating the heterotrimeric SNF1 protein kinase complex is the Reg1-Glc7 protein phosphatase complex (reviewed in Sanz, P., et al., *Molecular and Cellular Biology*, 20(4):1321-1328 (2000)). Glc7 is an essential gene that encodes the catalytic subunit of protein phosphatase type 1. It is involved in glucose repression and the regulation of a variety of other cellular processes via the binding of specific regulatory subunits that target phosphatase to corresponding substrates. One of these regulatory subunits that targets Glc7 to substrates to repress glucose is Reg1. It is hypothesized that Glc7, in response to glucose and targeted by Reg1, dephosphorylates the Snf1 α-subunit or another component of the heterotrimeric SNF1 protein kinase complex and thereby facilitates its conformational change from an active state to the autoinhibited form. Other findings suggest that Snf1 negatively regulates its own interaction with Reg1. It is demonstrated herein that SNF1 protein kinase activity would be decreased by modifying the Reg1-Glc7 protein phosphatase complex in a manner such that the phosphatase complex is hyperactive.

Hexokinase PII (Hxk2) is a glycolytic enzyme that, in addition to phosphorylating glucose, is involved in regulating glucose repression. More specifically, as summarized in the work of Sanz, P., et al. (supra), it appears that Hxk2 interacts with the heterotrimeric SNF1 protein kinase complex and/or the Reg1-Glc7 protein phosphatase complex. It is demonstrated herein that SNF1 protein kinase activity is decreased by modifying the activity of hexokinase PII.

Interestingly, Hxk2 has been found to regulate the expression of Glk1, Hxk1 and Hxk2 in *Saccharomyces cerevisiae* (Rodríguez, A. et al., *Biochem J.*, 355(3):625-631 (2001)). Specifically, it was demonstrated therein that Hxk2 is involved in the glucose-induced repression of the HXK1 and GLK1 genes and the glucose-induced expression of the HXK2 gene, while Hxk1 is involved as a negative factor in the expression of the GLK1 and HXK2 genes.

Although the heterotrimeric SNF1 protein kinase may affect hundreds of proteins within a cell, determination of those proteins that are directly (versus indirectly) affected by the kinase may be difficult and thus extensive screening and analysis may be required. The interplay between various downstream proteins may also be subject to variability, depending on growth conditions, etc.

Despite the uncertainty above, microarray analyses have been used extensively to understand the metabolic reprogramming that occur during environmental changes or in various deletion mutants, and the expression patterns of many previously uncharacterized genes provide clues to their possible functions. For example, DeRisi et al. (Science, 278 (5338):680-686 (1997)) identified Sip4 and Hap4 as important transcription factors for the diauxic shift of *S. cerevisiae* using microarray analysis.

A similar methodology was utilized herein to identify potentially important proteins within the heterotrimeric SNF1 protein kinase network of *Yarrowia lipolytica* that could be responsible for phenotypical differences between snf1 deletion mutants and wild type strains. Among these, two potential zinc finger proteins showed increased transcription of their cognitive genes in snf1 deletion strains as compared to those in the wild type. These are proteins are homologous to *S. cerevisiae* Rme1 and *S. cerevisiae* Mhy1.

It is well known that many $Cys_2His_2$-type zinc-finger proteins are transcription factors that are involved in gene expression. For example, the *S. cerevisiae* Rme1 (GenBank Accession No. NP_011558) is a zinc-finger protein that functions as a transcriptional repressor of the meiotic activator IME1 (Covitz, P. A., and Mitchell, A. P., *Genes Dev.*, 7:1598-1608 (1993)). The *Yarrowia* Rme1 homolog (SEQ ID NO:116) and the Mhy1 zinc-finger protein homolog (SEQ ID NO:121) were both differentially expressed by more than 1.54-fold in snf1Δ strains. These proteins have not been characterized and may be potentially important transcription factors for lipid metabolism in *Y. lipolytica*.

In addition, expression of genes encoding a homolog of the *S. cerevisiae* SNF3 gene was upregulated in the snf1Δ strain. The SNF3 gene is required for high-affinity glucose transport in the yeast *Saccharomyces cerevisiae* and has also been implicated in control of gene expression by glucose repression.

In addition to the proteins above, a variety of proteins are activated by dephosphorylation by active heterotrimeric SNF1 protein kinase (although the heterotrimeric SNF1 protein kinase is unable to perform the reverse reaction, i.e., inactivation by phosphorylation). Within this family of proteins that rely on the heterotrimeric SNF1 protein kinase, both acetyl-CoA carboxylase ["ACC"] and diacylglycerol acyltransferases ["DGATs"] play a tremendous role in lipid biosythesis. Specifically, ACC (EC 6.4.1.2) catalyzes the key regulated step in fatty acid synthesis. DGAT (EC 2.3.1.20) is the enzyme exclusively committed to triacylglycerol ["TAG"] biosynthesis, catalyzing the conversion of acyl-CoA and 1,2-diacylglycerol to CoA and TAGs, the main storage lipids in cells. Two families of DGAT enzymes exist: DGAT1 and DGAT2.

Unfortunately, the exact phosphorylation site within ACC and DGAT is known in very few ACC and DGAT sequences. For example, although serine residue 79 ["Ser-79"] of rat ACC (GenBank Accession No. NP_071529; SEQ ID NO:147) is entirely responsible for the inactivation of ACC by AMPK (Davies, S. P. et al., *Eur. J. Biochem.*, 187:183-190 (1990); Ha, J., et al., *J. Biol. Chem.*, 269(35):22162-22168 (1994)), the corresponding Ser-79 residue is not present in either *S. cerevisiae* or *Yarrowia lipolytica*. A consensus phosphorylation site for the AMPK/Snf1 protein kinase family has been suggested to be Hyd-(Xaa-Bas)-Xaa-Xaa-Ser/Thr-Xaa-Xaa-Xaa-Hyd (SEQ ID NO:148), where Hyd is a bulky hydrophobic side chain (i.e., Leu, Met, Ile, Phe, or Val), Bas is a basic residue (i.e., Arg, Lys or His, wherein Arg is more basic than Lys, which is more basic than His), and Xaa is any amino acid residue (reviewed in Hardie, D. G., et al., *Annu. Rev. Biochem.*, 67:821-855 (1998)). One of skill in the art will be able to determine the appropriate Ser/Thr phosphorylation site(s) within a particular ACC or DGAT protein that permits the protein's activation by dephosphorylation by active heterotrimeric SNF1 protein kinase. Mutation of the phosphorylation site, such that the Ser/Thr residue is replaced with an unphosphorylatable neutral residue (e.g., Ala), will prevent down-regulation of the ACC or DGAT protein by active heterotrimeric SNF1 protein kinase. This is expected to increased lipid production in the cell (Xu, Jingyu et al., *Plant Biotech. J.*, 6(8):799-818 (2008).

As previously described, the SNF1-AMPK family of protein kinases includes highly conserved AMP-activated protein kinases [AMPK] in mammals, SNF1 protein kinases in yeast/fungi, and SNF1-related kinases in plants. There are no known homologs to these protein kinases in bacteria.

Numerous studies examining effects of various modifications, such as deletions, mutations and knockouts, within various domains and subunits of the *Saccharomyces cerevisiae* SNF1 protein kinase have been conducted. Sequence conservation within each of the various SNF1 protein kinase subunits, to wit, Snf1, Sip1, Sip2, Gal83, Snf4, has permitted identification of many orthologous proteins in silico, as observed by entries in, e.g., GenBank and as demonstrated in the present Application (Table 3).

TABLE 3

GenBank Accession Numbers Of Some SNF1 Protein Kinase Network Genes

| Organism | Snf1 | β-subunit | Snf4 | Upstream Kinases of Snf1 | Reg1 | Hexokinases/ Glucokinases |
|---|---|---|---|---|---|---|
| Saccharomyces cerevisiae | NP_010765; M13971 [SEQ ID NO: 2] | NP_010944 [Gal83]; X72893 [Gal83; SEQ ID NO: 10]; NP_010710 [Sip1]; M90531 [Sip1; SEQ ID NO: 6]; NP_011307 [Sip2]; L31592 [Sip2; SEQ ID NO: 8] | NP_011400; M30470 [SEQ ID NO: 4] | NP_011055 [Sak1]; NC_001137 [Sak1; SEQ ID NO: 12] NP_011336 [Tos3; SEQ ID NO: 13]; NP_012876 [Elm1]; M81258 [Elm1; SEQ ID NO: 15] | NP_010311 [Reg1; SEQ ID NO: 56]; NP_009606 [Reg2] | NP_011261 [Hxk2; SEQ ID NO: 57]; NP_116711 [Hxk1]; NP_009890 [Glk1] |
| Kluyveromyces lactis | XP_451166; X87975 [SEQ ID NO: 17] | XP_451556; CAA53162; X75408 [SEQ ID NO: 19] | XP_455570 | XP_453478; XP_456280 | XP_455276 | XP_453567; XP_452246 |
| Candida albicans | XP_715699; L78129 [SEQ ID NO: 21] | XP_714255; XP_714117; XP_722202 | XP_718037 | XP_717320; XP_717244; XP_717659; XP_710213 | XP_719582; XP_719454 | XP_717405; XP_713116; XP_713093 |
| Candida tropicalis | BAA75889; AB024535 [SEQ ID NO: 23] | — | — | — | — | — |
| Candida glabrata | XP_449733; L78130 [SEQ ID NO: 25] | XP_444928; XP_448626; XP_446102 | XP_446285 | XP_448319; XP_449916; XP_447575; XP_448505 | XP_448729 | XP_447127; XP_446000 |
| Schizosaccharomyces pombe | NP_588376 | NP_588485; BAA13800; | XP_001713093 | NP_588360; NP_588482; NP_001018849 | NP_592969 | NP_592948; NP_593865 |
| Cryptococcus neoformans | XP_571611; XP_774860 | XP_571430 | XP_566676; XP_778330 | XP_568873; XP_777051; XP_772523; XP_572331; XP_571611 | XP_571330; XP_774832 | XP_572328; XP_772520; XP_568853; XP_777070 |
| Aspergillus niger | XP_001390353 | XP_001396631 | XP_001401245 | XP_001398415; XP_001399047 | XP_001390557 | XP_001400569 |
| Aspergillus oryzae | XP_001823562 | XP_001822984 | XP_001824133 | XP_001819007 XP_001817083; | XP_001827713 | XP_001819202; XP_001823868 |
| Aspergillus nidulans | XP_681962 | XP_664174 | XP_664455 | XP_682096; XP_663332 | XP_682153 | XP_680728; XP_681958 |
| Aspergillus fumigatus | XP_749305 | XP_747628 | XP_753354 | XP_754034; XP_750441 | XP_746935 | XP_749720; XP_747854 |

TABLE 3-continued

GenBank Accession Numbers Of Some SNF1 Protein Kinase Network Genes

| Organism | Snf1 | β-subunit | Snf4 | Upstream Kinases of Snf1 | Reg1 | Hexokinases/ Glucokinases |
|---|---|---|---|---|---|---|
| *Aspergillus clavatus* | XP_001273048 | XP_001270106 | XP_001274578 | XP_001273932; XP_001269467 | XP_001275007 | XP_001275241; XP_001270306 |
| *Yarrowia lipolytica* | XP_502312; CR382130 [SEQ ID NO: 27] | XP_503921 [YALI0E13926p; SEQ ID NO: 32]; XP_501285 [YALI0C00429p; SEQ ID NO: 34] | XP_501397; SEQ ID NO: 30 | XP_502591 [YALI0D08822p; SEQ ID NO: 36]; XP_501022 [YALI0B17556p; SEQ ID NO: 38] | XP_500990 [SEQ ID NO: 91] | XP_501216 [YALI0B22308p; SEQ ID NO: 99]; XP_504178 [YALI0E20207p; SEQ ID NO: 101]; XP_503983 [YALI0E15488p; SEQ ID NO: 103] |
| *Neurospora crassa* | XP_958665.2 | XP_960596 | XP_956748 | XP_962989; XP_326032; XP_956802 | XP_963952 | XP_965673; XP_964736 |
| *Debaryomyces hansenii* | XP_459965 | XP_456800; XP_461990 | XP_457275 | XP_459013; XP_456706 | XP_456386 | XP_460972; XP_459592 |
| *Pichia stipitis* | XP_001386133 | XP_001384510; XP_001386934 | XP_001383761 | XP_001387026; XP_001382457 | XP_001382280 | XP_001386689; XP_001386072 |

When the sequence of a particular gene within the SNF1 protein kinase network (i.e., a gene encoding the α, β and/or γ subunit, an upstream regulatory protein or a downstream protein that is regulated by the heterotrimeric SNF protein kinase) or a protein thereof within a preferred host organism is not known, one skilled in the art will recognize that it will be most desirable to identify and isolate these genes or portions thereof prior to regulating the activity of the encoded proteins to thereby alter the total lipid content in the eukaryote. Knowing these sequences, especially e.g., Snf1, Sip1, Sip2, Gal83, Snf4, facilitates targeted disruption in the desired host.

The SNF1 protein kinase network sequences of Table 3 may be used to search for homologs in the same or other algal, fungal, oomycete, euglenoid, stramenopiles, or yeast species using sequence analysis software. In general, such computer software matches similar sequences by assigning degrees of homology to various substitutions, deletions, and other modifications. Use of software algorithms, such as the BLASTP method of alignment with a low complexity filter and the following parameters: Expect value=10, matrix=Blosum 62 (Altschul, et al., *Nucleic Acids Res.*, 25:3389-3402 (1997)), is well-known for comparing any SNF1 protein kinase network protein in Table 3 against a database of nucleic or protein sequences to thereby identify similar known sequences within a preferred host organism.

Using a software algorithm to comb through databases of known sequences is particularly suitable for the isolation of homologs having a relatively low percent identity, such as those described in Table 3. It is predictable that isolation would be relatively easier for SNF1 protein kinase homologs of at least about 70%-85% homology with publicly available SNF1 protein kinase network sequences. Further, those sequences that are at least about 85%-90% identical would be particularly suitable for isolation and those sequences that are at least about 90%-95% identical would be the most facilely isolated.

*Saccharomyces cerevisiae* proteins of the heterotrimeric SNF1 protein kinase were utilized as query sequences against the *Yarrowia lipolytica* genome database, to readily identify the corresponding *Yarrowia* homolog. Thus, for example, the gene encoding Snf1 in a preferred eukaryotic host cell would be expected to have homology to the *S. cerevisiae* protein set forth as SEQ ID NO:2 and/or other Snf1 proteins such as those described in Table 3.

Some subunit homologs of SNF1 protein kinases have also been isolated by the use of motifs unique to serine/threonine kinases. For example, it is well known that Snf1 comprises conserved Asp-Phe-Gly [DFG] and Ala-Pro-Glu [APE] motifs within the N-terminal activation-loop segment. These motifs flank the threonine residue that is phosphorylated upon Snf1 activation (Hardie, D. G. and D. Carling, *Eur. J. Biochem.*, 246:259-273 (1997)). This region of "conserved domains" corresponds to a set of amino acids that are highly conserved at specific positions and are essential to the structure, stability or activity of the Snf1 protein. For example, alteration of the Thr210 of ScSnf1 (SEQ ID NO:2) to Ala, Glu or Asp has been demonstrated to result in an inactive kinase (Estruch, F., et al., *Genetics*, 132:639-650 (1992); Ludin, K., et al., *Proc. Natl. Acad. Sci. U.S.A.*, 95:6245-6250 (1999)). Relatedly, Snf4 contains two pairs of cystathionine-β-synthase [CBS] repeats, identified as Bateman domains (Bateman, A., *Trends Biochem. Sci.*, 22:12-13 (1997)). Motifs are identified by their high degree of conservation in aligned sequences of a family of protein homologues, and thus also can be used as unique "signatures" to determine if a protein with a newly determined sequence belongs to a previously identified protein family. As is well known to one of skill in the art, these motifs are useful as diagnostic tools for the rapid identification of novel Snf1, Snf4, Sip1, Sip2 and/or Gal83 genes, respectively.

Alternatively, publicly available sequences encoding genes of the SNF1 protein kinase network or motifs thereof may be employed as hybridization reagents for the identification of homologs. The basic components of a nucleic acid hybridization test include a probe, a sample suspected of containing the gene or gene fragment of interest, and a specific hybridization method. Probes are typically single-stranded nucleic acid sequences that are complementary to the nucleic acid sequences to be detected. Probes are "hybridizable" to the nucleic acid sequence to be detected. Although the probe length can vary from 5 bases to tens of thousands of bases, typically a probe length of about 15 bases to about 30 bases is suitable. Only part of the probe molecule need be complementary to the nucleic acid sequence to be detected. In addition, the complementarity between the probe and the target sequence need not be perfect. Hybridization does occur between imperfectly complementary molecules with the result that a certain fraction of the bases in the hybridized region are not paired with the proper complementary base.

Hybridization methods are well defined. Typically the probe and sample must be mixed under conditions that will permit nucleic acid hybridization. This involves contacting the probe and sample in the presence of an inorganic or organic salt under the proper concentration and temperature conditions. The probe and sample nucleic acids must be in contact for a long enough time that any possible hybridization between the probe and sample nucleic acid occurs. The concentration of probe or target in the mixture will determine the time necessary for hybridization to occur. The higher the probe or target concentration, the shorter the hybridization incubation time needed. Optionally, a chaotropic agent may be added, such as e.g., guanidinium chloride, guanidinium thiocyanate, sodium thiocyanate, lithium tetrachloroacetate, sodium perchlorate, rubidium tetrachloroacetate, potassium iodide or cesium trifluoroacetate If desired, one can add formamide to the hybridization mixture, typically 30-50% (v/v) ["by volume"].

Various hybridization solutions can be employed. Typically, these comprise from about 20 to 60% volume, preferably 30%, of a polar organic solvent. A common hybridization solution employs about 30-50% v/v formamide, about 0.15 to 1 M sodium chloride, about 0.05 to 0.1 M buffers (e.g., sodium citrate, Tris-HCl, PIPES or HEPES (pH range about 6-9)), about 0.05 to 0.2% detergent (e.g., sodium dodecylsulfate), or between 0.5-20 mM EDTA, FICOLL (Pharmacia Inc.) (about 300-500 kdal), polyvinylpyrrolidone (about 250-500 kdal), and serum albumin. Also included in the typical hybridization solution will be unlabeled carrier nucleic acids from about 0.1 to 5 mg/mL, fragmented nucleic DNA such as calf thymus or salmon sperm DNA, or yeast RNA, and optionally from about 0.5 to 2% wt/vol ["weight by volume"] glycine. Other additives may also be included, such as volume exclusion agents that include a variety of polar water-soluble or swellable agents, e.g., polyethylene glycol, anionic polymers e.g., polyacrylate or polymethylacrylate and anionic saccharidic polymers, such as dextran sulfate.

Nucleic acid hybridization is adaptable to a variety of assay formats. One of the most suitable is the sandwich assay format. The sandwich assay is particularly adaptable to hybridization under non-denaturing conditions. A primary component of a sandwich-type assay is a solid support. The solid support has adsorbed or covalently coupled to it immobilized nucleic acid probe that is unlabeled and complementary to one portion of the sequence.

Any of the nucleic acid fragments encoding genes of the SNF1 protein kinase network or any identified homologs may be used to isolate genes encoding homologous proteins from the same or other algal, fungal, oomycete, euglenoid, stramenopiles or yeast species. Isolation of homologous genes using sequence-dependent protocols is well known in the art. Examples of sequence-dependent protocols include, but are not limited to: 1) methods of nucleic acid hybridization; 2) methods of DNA and RNA amplification, as exemplified by various uses of nucleic acid amplification technologies, such as polymerase chain reaction ["PCR"], (U.S. Pat. No. 4,683, 202); ligase chain reaction ["LCR"] (Tabor, S. et al., *Proc. Natl. Acad. Sci. U.S.A.*, 82:1074 (1985)); or strand displacement amplification ["SDA"](Walker, et al., *Proc. Natl. Acad. Sci. U.S.A.*, 89:392 (1992); and 3) methods of library construction and screening by complementation.

For example, genes encoding proteins or polypeptides similar to publicly available Snf1, Snf4, Sip1, Sip2 and/or Gal83 or their motifs could be isolated directly by using all or a portion of those publicly available nucleic acid fragments as DNA hybridization probes to screen libraries from any desired organism using methodology well known to those skilled in the art. Specific oligonucleotide probes based upon the publicly available nucleic acid sequences can be designed and synthesized by methods known in the art (Maniatis, supra). Moreover, the entire sequences can be used directly to synthesize DNA probes by methods known to the skilled artisan, such as random primers DNA labeling, nick translation or end-labeling techniques, or RNA probes using available in vitro transcription systems. In addition, specific primers can be designed and used to amplify a part or the full length of the publicly available sequences or their motifs. The resulting amplification products can be labeled directly during amplification reactions or labeled after amplification reactions, and used as probes to isolate full-length DNA fragments under conditions of appropriate stringency.

Typically, in PCR-type amplification techniques, the primers have different sequences and are not complementary to each other. Depending on the desired test conditions, the sequences of the primers should be designed to provide for both efficient and faithful replication of the target nucleic acid. Methods of PCR primer design are common and well known in the art (Thein and Wallace, "The use of oligonucleotides as specific hybridization probes in the Diagnosis of Genetic Disorders", in *Human Genetic Diseases: A Practical Approach*, K. E. Davis Ed., (1986) pp 33-50, IRL: Herndon, Va.; and Rychlik, W., In *Methods in Molecular Biology*, White, B. A. Ed., (1993) Vol. 15, pp 31-39, PCR Protocols: Current Methods and Applications. Humania: Totowa, N.J.).

Generally two short segments of available sequences from SNF1 protein kinase network genes may be used in PCR protocols to amplify longer nucleic acid fragments encoding homologous genes from DNA or RNA. PCR may also be performed on a library of cloned nucleic acid fragments wherein the sequence of one primer is derived from the available nucleic acid fragments or their motifs. The sequence of the other primer takes advantage of the presence of the polyadenylic acid tracts to the 3' end of the mRNA precursor encoding genes.

Alternatively, the second primer sequence may be based upon sequences derived from the cloning vector. For example, the skilled artisan can follow the RACE protocol (Frohman et al., *Proc. Natl. Acad. Sci. U.S.A.*, 85:8998 (1988)) to generate cDNAs by using PCR to amplify copies of the region between a single point in the transcript and the 3' or 5' end. Primers oriented in the 3' and 5' directions can be designed from the available sequences. Using commercially available 3' RACE or 5' RACE systems (e.g., BRL, Gaithersburg, Md.), specific 3' or 5' cDNA fragments can be isolated (Ohara et al., *Proc. Natl. Acad. Sci. U.S.A.*, 86:5673 (1989); Loh et al., *Science*, 243:217 (1989)).

Based on any of these well-known methods just discussed, it would be possible to identify and/or isolate homologous genes encoding the α-, β-, or γ-subunit of the heterotrimeric SNF1 protein kinase (including Snf1, Sip1, Sip2, Gal83 and Snf4), genes encoding the upstream regulatory proteins (including e.g., Sak1, Tos1, Elm1, Hxk2, Reg1 and Glc7) and/or genes encoding downstream proteins that are regulated by the heterotrimeric SNF1 protein kinase (including e.g., Rme1, Mhy1, Cbr1, Snf3, ACC, DGAT) in any preferred eukaryotic organism of choice. The activity of any putative SNF1 protein kinase network protein can readily be confirmed by manipulating the activity of the endogenous gene(s) within the host organism, according to the methods described herein, since the total lipid content will be increased in the transgenic eukaryotic host relative to the total lipid content within a non-transgenic eukaryotic host.

Described herein is a method for increasing the total lipid content of an oleaginous eukaryotic host cell comprising a heterotrimeric SNF1 protein kinase, said method comprising:

(a) transforming the oleaginous eukaryotic host cell whereby there is a reduction in activity of the heterotrimeric SNF1 protein kinase when compared to the level of activity of a heterotrimeric SNF1 protein kinase in a non-transformed oleaginous eukaryotic host cell;

(b) growing the transformed cell of step (a) under suitable conditions whereby the total content of lipid is increased when compared to the total content of lipid obtained from a non-transformed oleaginous eukaryotic host cell having a heterotrimeric SNF1 protein kinase without reduced activity; and (c) optionally, recovering oil or lipids from the cell of step (b).

Based on previous disclosure, it will be apparent that the reduction in activity of the heterotrimeric SNF1 protein kinase for the method described above can therefore be accomplished by (a) altering an upstream regulatory protein associated with the heterotrimeric SNF1 protein kinase; (b) altering a polynucleotide encoding a subunit of the heterotrimeric SNF1 protein kinase; or (c) altering a downstream protein regulated by the heterotrimeric SNF1 protein kinase. More specifically, the methods for increasing the total lipid content of an oleaginous eukaryotic host cell can be achieved by reducing the activity of the heterotrimeric SNF1 protein kinase, by a means selected from the group consisting of:

(a) down-regulating an upstream regulatory protein associated with the heterotrimeric SNF1 protein kinase, said upstream regulatory protein being a kinase selected from the group consisting of Sak1, Tos3 and Elm1;

(b) up-regulating an upstream regulatory protein associated with the heterotrimeric SNF1 protein kinase, said upstream regulatory protein being a hexokinase consisting of hexokinase isoenzyme 2 (Hxk2);

(c) up-regulating an upstream regulatory protein associated with the heterotrimeric SNF1 protein kinase, said upstream regulatory protein being a glucokinase (Glk1);

(d) up-regulating an upstream regulatory protein associated with the heterotrimeric SNF1 protein kinase, said upstream regulatory protein being a protein of the Reg1-Glc7 protein-phosphatase 1 complex, selected from the group consisting of Reg1 and Glc7;

(e) down-regulating a polynucleotide encoding the SNF1 α-subunit of the heterotrimeric SNF1 protein kinase;

(f) up-regulating the regulatory domain of a polynucleotide encoding the SNF1 α-subunit of the heterotrimeric SNF1 protein kinase;

(g) up-regulation of a catalytically inactive Snf1 α-subunit;

(h) down-regulation of a polynucleotide encoding the SNF1 β-subunit of the heterotrimeric SNF1 protein kinase, said β-subunit consisting of Gal83;

(i) down-regulation of a polynucleotide encoding the SNF1 γ-subunit of the heterotrimeric SNF1 protein kinase;

(j) up-regulation of a downstream protein regulated by the heterotrimeric SNF1 protein kinase, said downstream protein being a zinc-finger protein selected from the group consisting of Rme1 and Mhy1;

(k) up-regulation of a downstream protein regulated by the heterotrimeric SNF1 protein kinase, said downstream protein being a microsomal cytochrome $b_5$ reductase (Cbr1);

(l) up-regulating a downstream protein regulated by the heterotrimeric SNF1 protein kinase, said downstream protein being a glucose transporter (Snf3); or (m) up-regulating a mutant variant of a downstream protein regulated by phosphorylation by the heterotrimeric SNF1 protein kinase, said downstream protein being a protein selected from the group consisting of acetyl-CoA carboxylase and diacylglycerol acyltransferase, and wherein said mutant variant can not be phosphorylated by the heterotrimeric SNF1 protein kinase.

When the oleaginous eukaryotic host cell is *Yarrowia lipolytica*, any of the following proteins could therefore be manipulated according to the methods above: SEQ ID NO:36 [YlSak1], SEQ ID NO:38 [YlElm1], SEQ ID NO:27 [YlSnf1], SEQ ID NO:32 [YlGal83], SEQ ID NO:34 [YlSip2], SEQ ID NO:30 [YlSnf4], SEQ ID NO:91 [YlReg1], SEQ ID NO:101 [YlHxk2], SEQ ID NO:103 [YlGlk1], SEQ ID NO:116 [YlRme1], SEQ ID NO:121 [YlMhy1], SEQ ID NO:131 [YlCbr1], SEQ ID NO:144 [YlSnf3], SEQ ID NO:150 [YlACC], SEQ ID NO:182 [YlDGAT1] or SEQ ID NO:184 [YlDGAT2].

Also described herein is a method for increasing the total content of PUFAs in the microbial oil obtained from an oleaginous eukaryotic host cell comprising a heterotrimeric SNF1 protein kinase, said method comprising:

(a) transforming the oleaginous eukaryotic host cell with isolated polynucleotides encoding a functional PUFA biosynthetic pathway wherein there is also a reduction in activity of the heterotrimeric SNF1 protein kinase when compared to the level of activity of a heterotrimeric SNF1 protein kinase in a non-transformed oleaginous eukaryotic host cell;

(b) growing the transformed cell of step (a) under suitable conditions whereby the total content of lipid is increased when compared to the total content of lipid obtained from a non-transformed oleaginous eukaryotic host cell having a heterotrimeric SNF1 protein kinase without reduced activity; and (c) optionally, recovering oil or lipids from the cell of step (b).

Preferably, the genes encoding the functional PUFA biosynthetic pathway are selected from the group consisting of Δ9 desaturase, Δ12 desaturase, Δ6 desaturase, Δ5 desaturase, Δ17 desaturase, Δ8 desaturase, Δ15 desaturase, Δ4 desaturase, $C_{14-16}$ elongase, $C_{16/18}$ elongase, $C_{18/20}$ elongase, $C_{20/22}$ elongase and Δ9 elongase; the PUFA is an ω-3 fatty acid or an ω-6 fatty acid; and the reduction in activity of the heterotrimeric SNF1 protein kinase is due to a modification selected from the group consisting of: (a) altering an upstream regulatory protein associated with the heterotrimeric SNF1 protein kinase; (b) altering a polynucleotide encoding a subunit of the heterotrimeric SNF1 protein kinase; and (c) altering a downstream protein regulated by the heterotrimeric SNF1 protein kinase.

For example, the methods demonstrated herein result in transformed oleaginous *Yarrowia lipolytica* host cells producing increased total lipid content [TFAs % DCW] and increased EPA productivity [EPA % DCW], relative to those non-transformed oleaginous *Yarrowia lipolytica* host cells that do not have a reduction in the activity of the heterotrimeric SNF1 protein kinase (achieved by altering expression of e.g., Sak1, Snf1, Snf4, Gal83, Reg1, Hxk2, Glk1, Rme1, Cbr1 or Snf3).

In some of the methods described above, whereby the total lipid content of a transformed oleaginous eukaryotic host cell is increased (relative to a non-transformed host cell) due to a reduction in activity of the heterotrimeric SNF1 protein kinase, the ratio of desaturated fatty acids to saturated fatty acids is also increased (relative to a non-transformed host cell).

In all of these methods described above, down-regulation of a native gene encoding a protein within the heterotrimeric SNF1 protein kinase network can be accomplished by an insertion, deletion, or targeted mutation within a portion of the gene, for example, within the N-terminal portion of the protein, such as in the N-terminal activation-loop segment of Snf1, or within the C-terminal portion of the protein. Alternatively, down-regulation can result in a complete gene knockout, or the targeted mutation can result in a non-functional protein. In preferred methods described herein, the down-regulation that results in reduced activity of the heterotrimeric SNF1 protein kinase is accomplished by creation of a SNF1, SNF4, GAL83 or SIP2 gene knockout, which results in snf1Δ, snf4Δ, gal83Δ or sip2Δ cells, respectively.

In contrast, up-regulation of a native gene encoding a protein within the heterotrimeric SNF1 protein kinase network can be accomplished by means well known to one of skill in the art. For example, Reg1, Hxk2, Glk1, Rme1, Mhy1, Cbr1, Snf3, mutant ACC or mutant DGAT expression can be increased at the transcriptional level through the use of a stronger promoter (either regulated or constitutive) to cause increased expression, by removing/deleting destabilizing sequences from either the mRNA or the encoded protein, or by adding stabilizing sequences to the mRNA (U.S. Pat. No. 4,910,141). Alternately, additional copies of the gene(s) to be over-expressed may be introduced into the recombinant host cells to thereby increase total lipid content, either by cloning additional copies of genes within a single expression construct or by introducing additional copies into the host cell by increasing the plasmid copy number or by multiple integration of the cloned gene into the genome. The gene(s) to be over-expressed may be native to the oleaginous eukaryotic host cell or be heterologous.

The methods described herein can result in an increased total lipid content of the cell, an increased ratio of desaturated fatty acids to saturated fatty acids in the cell, and/or an increased total content of PUFAs in the cell and are generally applicable within all eukaryotic organisms because of the universal existence of the global regulator SNF1 protein kinase. However, the preferred eukaryotic host cell is oleaginous, that is, those organisms that tend to store their energy source in the form of lipids/oils.

As shown herein, reduction in the activity of the heterotrimeric SNF1 protein kinase (e.g., by gene knockout of the α-, β- or γ-subunit heterotrimeric SNF1 protein kinase, by gene knockout of Sak1, by over-expression of the regulatory domain of Snf1, or by over-expression of Hxk2, Glk1, Reg1, Rme1, Cbr1 or Snf3) results in creation of a mutant of the oleaginous yeast *Yarrowia lipolytica* that has an increased capacity to synthesize lipids/microbial oil within the cell. This is a novel observation that does not find validation in studies with other organisms. Without wishing to be held to any particular explanation or theory, it is hypothesized herein that reduction in the activity of the heterotrimeric SNF1 protein kinase within an oleaginous yeast cell results in constitutive oleaginy, thereby enabling oil biosynthesis to occur throughout the fermentation process and thus leads to increased accumulation of lipid within the cell (typically within a shorter time period). Additionally, the percent of PUFAs in the total lipid may be increased and the overall desaturation is altered, which results in modification to the lipid profile of the cells, as compared with an oleaginous yeast whose native SNF1 protein kinase has not been altered.

Constitutive oleaginy in the transformed cells is in direct contrast to typical fermentations with oleaginous yeast as described in U.S. Pat. No. 7,238,482. Typically, accumulation of high levels of PUFAs in oleaginous yeast cells requires a two-stage process, since the metabolic state must be "balanced" between growth and synthesis/storage of fats. In this approach, the first stage of the fermentation is dedicated to the generation and accumulation of cell mass and is characterized by rapid cell growth and cell division. In the second stage of the fermentation, it is preferable to establish conditions of nitrogen deprivation in the culture to promote high levels of lipid accumulation. The effect of this nitrogen deprivation is to reduce the effective concentration of AMP in the cells, thereby reducing the activity of the NAD-dependent isocitrate dehydrogenase of mitochondria. When this occurs, citric acid will accumulate, thus forming abundant pools of acetyl-CoA in the cytoplasm and priming fatty acid synthesis. Thus, this phase is characterized by the cessation of cell division followed by the synthesis of fatty acids and accumulation of oil.

Given these considerations, preferred methods described herein are directed toward an oleaginous eukaryotic host cell, such as algae, fungi, oomycetes, euglenoids, stramenopiles and yeast that comprise a disruption in the heterotrimeric SNF1 protein kinase, whereby the host cell comprises 25% of dry cell weight in oil. Especially preferred are oleaginous yeast of the genus *Yarrowia*, *Candida*, *Rhodotorula*, *Rhodosporidium*, *Cryptococcus*, *Trichosporon* or *Lipomyces*.

The Snf1 α-subunit of the SNF1 protein kinase provided herein can be defined as an isolated nucleotide molecule comprising:

a) a nucleotide sequence encoding a polypeptide having serine/threonine protein kinase activity, wherein the polypeptide has at least 80% amino acid identity, based on the BLASTP method of alignment, when compared to an amino acid sequence selected from the group consisting of: SEQ ID NO:2, SEQ ID NO:17, SEQ ID NO:21, SEQ ID NO:23, SEQ ID NO:25, SEQ ID NO:27;

b) a nucleotide sequence encoding a polypeptide having serine/threonine protein kinase activity, wherein the nucleotide sequence has at least 80% sequence identity, based on the BLASTN method of alignment, when compared to a nucleotide sequence selected from the group consisting of: SEQ ID NO:1, SEQ ID NO:16, SEQ ID NO:20, SEQ ID NO:22, SEQ ID NO:24 and SEQ ID NO:26;

c) a nucleotide sequence encoding a polypeptide having serine/threonine protein kinase activity, wherein the nucleotide sequence hybridizes under stringent conditions to a nucleotide sequence selected from the group consisting of: SEQ ID NO:1, SEQ ID NO:16, SEQ ID NO:20, SEQ ID NO:22, SEQ ID NO:24 and SEQ ID NO:26; or, d) a complement of the nucleotide sequence of (a), (b) or (c), wherein the complement and the nucleotide sequence consist of the same number of nucleotides and are 100% complementary.

In addition to the methods and the transformed oleaginous eukaryotic host cells described herein, also described are lipids or oils obtained from those transformed cells. These lipids and oils may define or be incorporated into products described herein, which are useful as foods, animal feeds or in industrial applications and/or as by-products in foods or animal feeds. For example, the eukaryotic cells whose heterotrimeric SNF1 protein kinase has been manipulated to result in increased lipid accumulation would be extremely desirable for use in the production of bio-diesel fuels.

The invention includes modification of the heterotrimeric SNF1 protein kinase within a preferred host cell. Although numerous techniques are available to one of skill in the art to achieve such modification, generally, the endogenous activity of a particular gene can be reduced or eliminated by the following techniques, for example: 1) modifying the gene through insertion, substitution and/or deletion of all or part of the target gene; or 2) over-expressing a mutagenized heterosubunit (i.e., in an enzyme that comprises two or more heterosubunits) to thereby reduce the enzyme's activity as a result of the "dominant negative effect". Both of these techniques are discussed below. However, one skilled in the art would appreciate that these are well described in the existing literature and are not limiting to the methods, host cells, and products described herein. One skilled in the art will also appreciate the most appropriate technique for use with any particular oleaginous yeast.

Modification Via Insertion, Substitution And/Or Deletion: For gene modification, a foreign DNA fragment, typically a selectable marker gene, is inserted into the structural gene in order to modify the functionality of the gene. Transformation of the disruption cassette into the host cell results in replacement of the functional native gene by homologous recombination with the non-functional disrupted gene (see, for example: Hamilton et al., *J. Bacteriol.*, 171:4617-4622 (1989); Balbas et al., *Gene*, 136:211-213 (1993); Gueldener et al., *Nucleic Acids Res.*, 24:2519-2524 (1996); and Smith et al., *Methods Mol. Cell. Biol.*, 5:270-277 (1996)). One skilled in the art will appreciate the many variations of the general method of gene targeting, which admit of positive or negative selection, creation of gene knockouts, and insertion of exogenous DNA sequences into specific genome sites in filamentous fungi, algae, oomycetes, euglenoids, stramenopiles, yeast and/or microbial systems.

In contrast, a non-specific method of gene modification is the use of transposable elements or transposons. Transposons are genetic elements that insert randomly into DNA but can be later retrieved on the basis of sequence to determine the locus of insertion. Both in vivo and in vitro transposition techniques are known and involve the use of a transposable element in combination with a transposase enzyme. When the transposable element or transposon is contacted with a nucleic acid fragment in the presence of the transposase, the transposable element will randomly insert into the nucleic acid fragment. The technique is useful for random mutagenesis and for gene isolation, since the disrupted gene may be identified on the basis of the sequence of the transposable element. Kits for in vitro transposition are commercially available and include the Primer Island Transposition Kit, available from Perkin Elmer Applied Biosystems, Branchburg, N.J., based upon the yeast Ty1 element, the Genome Priming System, available from New England Biolabs, Beverly, Mass., based upon the bacterial transposon Tn7, and the EZ::TN Transposon Insertion Systems, available from Epicentre Technologies, Madison, Wis., based upon the Tn5 bacterial transposable element.

The Dominant Negative Effect: Dominant negative inhibition is most commonly seen when a mutant subunit of a multisubunit protein is coexpressed with the wild-type protein so that assembly of a functional oligomer is impaired (Herskowitz, I., *Nature*, 329(6136):219-22 (1987)). Thus, dominant negative inhibition is a phenomenon in which the function of a wild-type gene product is impaired as a result of a coexpressed mutant variant of the same gene product. Using means well known to one of skill in the art, dominant negative inhibition of an oleaginous yeast's native heterotrimeric SNF1 protein kinase could be created to thereby result in increased lipid accumulation, as compared with an oleaginous yeast whose native heterotrimeric SNF1 protein kinase has not been disrupted.

The skilled person is able to use these and other well known techniques to modify a gene encoding a upstream regulatory protein of the heterotrimeric SNF1 protein kinase, a subunit encoding the heterotrimeric SNF1 protein kinase, or a downstream protein that is regulated by the heterotrimeric SNF1 protein kinase within the preferred host cells described herein, such as mammalian systems, plant cells, filamentous fungi, algae, oomycetes, euglenoids, stramenopiles and yeast. For example, other disruption techniques include 1) using sense, antisense or iRNA technology; 2) using a host cell which naturally has [or has been mutated to have] little or none of the specific gene's activity; 3) over-expressing a mutagenized heterosubunit (i.e., in an enzyme that comprises two or more heterosubunits) to thereby reduce the enzyme's activity as a result of the "dominant negative effect"; 4) manipulating transcription and translation factors controlling the expression of the protein; and/or 5) manipulating signal transduction pathways controlling expression of the protein.

One skilled in the art is able to discern the optimum means to modify the native heterotrimeric SNF1 protein kinase to achieve increased accumulation of lipids as compared with a eukaryotic organisms whose native heterotrimeric SNF1 protein kinase has not been disrupted.

Standard resource materials that are useful to make recombinant constructs describe, inter alia: 1) specific conditions and procedures for construction, manipulation and isolation of macromolecules, such as DNA molecules, plasmids, etc.; 2) generation of recombinant DNA fragments and recombinant expression constructs; and 3) screening and isolating of clones. See, Sambrook, J., Fritsch, E. F. and Maniatis, T., *Molecular Cloning: A Laboratory Manual*, $2^{nd}$ ed., Cold Spring Harbor Laboratory: Cold Spring Harbor, N.Y. (1989) (hereinafter "Maniatis"); by Silhavy, T. J., Bennan, M. L. and Enquist, L. W., *Experiments with Gene Fusions*, Cold Spring Harbor Laboratory: Cold Spring Harbor, N.Y. (1984); and by Ausubel, F. M. et al., *Current Protocols in Molecular Biology*, published by Greene Publishing Assoc. and Wiley-Interscience, Hoboken, N.J. (1987).

In general, the choice of sequences included in the construct depends on the desired expression products, the nature of the host cell and the proposed means of separating transformed cells versus non-transformed cells. The skilled artisan is aware of the genetic elements that must be present on the plasmid vector to successfully transform, select and propagate host cells containing the chimeric gene. Typically, however, the vector or cassette contains sequences directing transcription and translation of the relevant gene(s), a selectable marker and sequences allowing autonomous replication or chromosomal integration. Suitable vectors comprise a region 5' of the gene that controls transcriptional initiation, i.e., a promoter, the gene coding sequence, and a region 3' of the DNA fragment that controls transcriptional termination, i.e., a terminator. It is most preferred when both control regions are derived from genes from the transformed host cell, although they need not be derived from genes native to the production host.

Transcription initiation regions or promoters useful for driving expression of heterologous genes or portions of them in the desired host cell are numerous and well known. These control regions may comprise a promoter, enhancer, silencer, intron sequences, 3' UTR and/or 5' UTR regions, and protein and/or RNA stabilizing elements. Such elements may vary in their strength and specificity. Virtually any promoter, i.e., native, synthetic, or chimeric, capable of directing expression of these genes in the selected host cell is suitable, although transcriptional and translational regions from the host species are particularly useful. Expression in a host cell can occur in an induced or constitutive fashion. Induced expression occurs by inducing the activity of a regulatable promoter operably linked to the SNF1 protein kinase network gene of interest, while constitutive expression occurs by the use of a constitutive promoter.

3' non-coding sequences encoding transcription termination regions may be provided in a recombinant construct and may be from the 3' region of the gene from which the initiation region was obtained or from a different gene. A large number of termination regions are known and function satisfactorily in a variety of hosts when utilized in both the same and different genera and species from which they were derived. Termination regions may also be derived from various genes native to the preferred hosts. The termination region is usually selected more for convenience rather than for any particular property.

Particularly useful termination regions for use in yeast are derived from a yeast gene, particularly *Saccharomyces, Schizosaccharomyces, Candida, Yarrowia* or *Kluyveromyces*. The 3'-regions of mammalian genes encoding γ-interferon and α-2 interferon are also known to function in yeast. The 3'-region can also be synthetic, as one of skill in the art can utilize available information to design and synthesize a 3'-region sequence that functions as a transcription terminator. A termination region may be unnecessary, but is highly preferred.

The vector may also comprise a selectable and/or scorable marker, in addition to the regulatory elements described above. Preferably, the marker gene is an antibiotic resistance gene such that treating cells with the antibiotic results in growth inhibition, or death, of untransformed cells and uninhibited growth of transformed cells. For selection of yeast transformants, any marker that functions in yeast is useful with resistance to kanamycin, hygromycin and the amino glycoside G418 and the ability to grow on media lacking uracil, lysine, histine or leucine being particularly useful.

Merely inserting a gene (e.g., encoding a protein of the heterotrimeric SNF1 protein kinase network) into a cloning vector does not ensure its expression at the desired rate, concentration, amount, etc. In response to the need for a high expression rate, many specialized expression vectors have been created by manipulating a number of different genetic elements that control transcription, RNA stability, translation, protein stability and location, oxygen limitation, and secretion from the host cell. Some of the manipulated features include: the nature of the relevant transcriptional promoter and terminator sequences, the number of copies of the cloned gene and whether the gene is plasmid-borne or integrated into the genome of the host cell, the final cellular location of the synthesized protein, the efficiency of translation and correct folding of the protein in the host organism, the intrinsic stability of the mRNA and protein of the cloned gene within the host cell and the codon usage within the cloned gene, such that its frequency approaches the frequency of preferred codon usage of the host cell. Each of these may be used in the methods and host cells described herein to reduce the activity of the heterotrimeric SNF1 protein kinase (e.g., by altering expression of Sak1, Elm1, Tos3, Snf1, Snf4, Gal83, Sip1, Sip2, Reg1, Hxk1, Hxk2, Glk1, Rme1, Mhy1, Cbr1 or Snf3).

After a recombinant construct is created comprising at least one chimeric gene comprising a promoter, an open reading frame ["ORF"] encoding a heterotrimeric SNF1 protein kinase network protein and a terminator, it is placed in a plasmid vector capable of autonomous replication in the host cell or is directly integrated into the genome of the host cell. Integration of expression cassettes can occur randomly within the host genome or can be targeted through the use of constructs containing regions of homology with the host genome sufficient to target recombination with the host locus. Where constructs are targeted to an endogenous locus, all or some of the transcriptional and translational regulatory regions can be provided by the endogenous locus.

When two or more genes are expressed from separate replicating vectors, each vector may have a different means of selection and should lack homology to the other construct(s) to maintain stable expression and prevent reassortment of elements among constructs. Judicious choice of regulatory regions, selection means and method of propagation of the introduced construct(s) can be experimentally determined so that all introduced genes are expressed at the necessary levels to provide for synthesis of the desired products.

Constructs comprising the gene(s) of interest may be introduced into a host cell by any standard technique. These techniques include transformation, e.g., lithium acetate transformation (*Methods in Enzymology*, 194:186-187 (1991)), biolistic impact, electroporation, microinjection, vacuum filtration or any other method that introduces the gene of interest into the host cell.

For convenience, a host cell that has been manipulated by any method to take up a DNA sequence, for example, in an expression cassette, is referred to herein as "transformed" or "recombinant" or "transformant". The transformed host will have at least one copy of the expression construct and may have two or more, depending upon whether the gene is integrated into the genome, amplified, or is present on an extrachromosomal element having multiple copy numbers.

The transformed host cell can be identified by selection for a marker contained on the introduced construct. Alternatively, a separate marker construct may be co-transformed with the desired construct, as many transformation techniques introduce many DNA molecules into host cells.

Typically, transformed hosts are selected for their ability to grow on selective media, which may incorporate an antibiotic or lack a factor necessary for growth of the untransformed host, such as a nutrient or growth factor. An introduced marker gene may confer antibiotic resistance, or encode an essential growth factor or enzyme, thereby permitting growth on selective media when expressed in the transformed host. Selection of a transformed host can also occur when the expressed marker protein can be detected, either directly or indirectly. Additional selection techniques are described in U.S. Pat. No. 7,238,482 and U.S. Pat. No. 7,259,255.

Regardless of the selected host or expression construct, multiple transformants must be screened to obtain a strain displaying the desired expression level, regulation and pattern. For example, Juretzek et al. (*Yeast*, 18:97-113 (2001)) note that the stability of an integrated DNA fragment in *Yarrowia lipolytica* is dependent on the individual transformants, the recipient strain and the targeting platform used. Such screening may be accomplished by Southern analysis of DNA blots (Southern, *J. Mol. Biol.*, 98:503 (1975)), Northern analysis of mRNA expression (Kroczek, *J. Chromatogr. Biomed. Appl.*, 618(1-2):133-145 (1993)), Western analysis of protein expression, phenotypic analysis or GC analysis of the lipid and PUFA products.

A variety of eukaryotic organisms are suitable hosts according to the methods herein, wherein the resultant transgenic host comprises a reduction in the activity of the heterotrimeric SNF1 protein kinase and wherein the total lipid content of the cell is increased (and optionally, the total PUFA content in the cell is increased and/or the ratio of desaturated fatty acids to saturated fatty acids in the cell is increased), as compared to a eukaryotic organism whose native the heterotrimeric SNF1 protein kinase has not been altered. The hosts may grow on a variety of feedstocks, including simple or complex carbohydrates, fatty acids, organic acids, oils, glycerols and alcohols, and/or hydrocarbons over a wide range of temperature and pH values. For example, various fungi, algae, oomycetes, yeasts, stramenopiles and/or euglenoids may be useful hosts. Non-oleaginous organisms such as *Saccharomyces cerevisiae* may also be useful as the host cells, since reduction in the activity of the heterotrimeric SNF1 protein kinase in these organisms may result in sufficient accumulation of lipid as to classify the disrupted mutants as oleaginous.

Preferred hosts are oleaginous eukaryotic organisms. These oleaginous organisms are naturally capable of oil synthesis and accumulation, wherein the total oil content can comprise greater than about 25% of the dry cell weight, more preferably greater than about 30% of the dry cell weight, and most preferably greater than about 40% of the dry cell weight. Various bacteria, algae, euglenoids, moss, fungi, yeast and stramenopiles are naturally classified as oleaginous. Within this broad group of hosts, of particular interest are those organisms that naturally produce ω-3/ω-6 fatty acids. For example, ARA, EPA and/or DHA is produced via *Cyclotella* sp., *Crypthecodinium* sp., *Mortierella* sp., *Nitzschia* sp., *Pythium*, *Thraustochytrium* sp. and *Schizochytrium* sp. The method of transformation of *M. alpina* is described by Mackenzie et al. (*Appl. Environ. Microbiol.*, 66:4655 (2000)). Similarly, methods for transformation of Thraustochytriales microorganisms (e.g., *Thraustochytrium*, *Schizochytrium*) are disclosed in U.S. Pat. No. 7,001,772. In alternate embodiments, a non-oleaginous organism can be genetically modified to become oleaginous, e.g., yeast such as *Saccharomyces cerevisiae*, prior to reduction in the activity of the heterotrimeric SNF1 protein kinase.

In more preferred embodiments, the oleaginous eukaryotic host cells are oleaginous yeast. Genera typically identified as oleaginous yeast include, but are not limited to: *Yarrowia*, *Candida*, *Rhodotorula*, *Rhodosporidium*, *Cryptococcus*, *Trichosporon* and *Lipomyces*. More specifically, illustrative oil-synthesizing yeast include: *Rhodosporidium toruloides*, *Lipomyces starkeyii*, *L. lipoferus*, *Candida revkaufi*, *C. pulcherrima*, *C. tropicalis*, *C. utilis*, *Trichosporon pullans*, *T. cutaneum*, *Rhodotorula glutinus*, *R. graminis* and *Yarrowia lipolytica* (formerly classified as *Candida lipolytica*). Most preferred is the oleaginous yeast *Yarrowia lipolytica*; and, in a further embodiment, most preferred are the *Y. lipolytica* strains designated as ATCC #76982, ATCC #20362, ATCC #8862, ATCC #18944 and/or LGAM S(7)1 (Papanikolaou S., and Aggelis G., *Bioresour. Technol.*, 82(1):43-9 (2002)).

The preferred method of expressing genes in *Yarrowia lipolytica* by integration of a linear DNA fragment into the genome of the host, preferred promoters, termination regions, integration loci and disruptions, and preferred selection methods when using this particular host species are provided in U.S. Pat. Pub. No. 2006-0094092-A1, U.S. Pat. Pub. No. 2006-0115881-A1, U.S. Pat. Pub. No. 2009-0093543-A1 and U.S. Pat. Pub. No. 2006-0110806-A1. Specific teachings applicable for engineering ARA, EPA and DHA production in *Y. lipolytica* are also included.

One of skill in the art would be able to use the cited teachings of in U.S. Pat. Pub. No. 2006-0094092-A1, U.S. Pat. Pub. No. 2006-0115881-A1, U.S. Pat. Pub. No. 2009-0093543-A1 and U.S. Pat. Pub. No. 2006-0110806-A1 to recombinantly engineer other host cells for PUFA production.

The transgenic eukaryotic host cell is grown under conditions that optimize lipid accumulation (and that optionally permit the greatest and the most economical yield of LC-PUFA(s)). In general, media conditions may be optimized by modifying the type and amount of carbon source, the type and amount of nitrogen source, the carbon-to-nitrogen ratio, the amount of different mineral ions, the oxygen level, growth temperature, pH, length of the biomass production phase, length of the oil accumulation phase and the time and method of cell harvest.

*Yarrowia lipolytica* are generally grown in a complex media such as yeast extract-peptone-dextrose broth ["YPD"] or a defined minimal media that lacks a component necessary for growth and thereby forces selection of the desired expression cassettes (e.g., Yeast Nitrogen Base (DIFCO Laboratories, Detroit, Mich.)).

Fermentation media for the methods and host cells described herein must contain a suitable carbon source, such as are taught in U.S. Pat. No. 7,238,482. Although it is contemplated that the source of carbon utilized may encompass a wide variety of carbon-containing sources, preferred carbon sources are sugars, glycerol and/or fatty acids. Most preferred is glucose and/or fatty acids containing between 10-22 carbons.

Nitrogen may be supplied from an inorganic (e.g., $(NH_4)_2SO_4$) or organic (e.g., urea or glutamate) source. In addition to appropriate carbon and nitrogen sources, the fermentation media must also contain suitable minerals, salts, cofactors, buffers, vitamins and other components known to those skilled in the art suitable for the growth and the promotion of the enzymatic pathways of lipid production. Particular attention is given to several metal ions, such as $Fe^{+2}$, $Cu^{+2}$, $Mn^{+2}$, $Co^{+2}$, $Zn^{+2}$, $Mg^{+2}$, that promote synthesis of lipids and PUFAs (Nakahara, T. et al., *Ind. Appl. Single Cell Oils*, D. J. Kyle and R. Colin, eds. pp 61-97 (1992)).

Preferred growth media for the methods and host cells described herein are common commercially prepared media, such as Yeast Nitrogen Base (DIFCO Laboratories, Detroit, Mich.). Other defined or synthetic growth media may also be used and the appropriate medium for growth of the transgenic host cells will be known by one skilled in the art of microbiology or fermentation science. A suitable pH range for the fermentation is typically between about pH 4.0 to pH 8.0, wherein pH 5.5 to pH 7.5 is preferred as the range for the initial growth conditions. The fermentation may be conducted under aerobic or anaerobic conditions, wherein microaerobic conditions are preferred.

In some aspects, the primary product is oleaginous yeast biomass. As such, isolation and purification of the oils from the biomass may not be necessary (i.e., wherein the whole cell biomass is the product). However, certain end uses and/or product forms may require partial and/or complete isolation/purification of the oil from the biomass, to result in partially purified biomass, purified oil, and/or purified LC-PUFAs.

Fatty acids, including PUFAs, may be found in the host organisms as free fatty acids or in esterified forms such as acylglycerols, phospholipids, sulfolipids or glycolipids, and may be extracted from the host cells through a variety of means well-known in the art. One review of extraction techniques, quality analysis and acceptability standards for yeast lipids is that of Z. Jacobs (*Critical Reviews in Biotech.*, 12(5/6):463-491 (1992)). A brief review of downstream processing is also available by A. Singh and O. Ward (*Adv. Appl. Microbiol.*, 45:271-312 (1997)).

In general, means for the purification of fatty acids may include extraction (e.g., U.S. Pat. No. 6,797,303 and U.S. Pat. No. 5,648,564) with organic solvents, sonication, supercritical fluid extraction (e.g., using carbon dioxide), saponification and physical means such as presses, or combinations thereof. See U.S. Pat. No. 7,238,482.

As demonstrated in the Examples and summarized in Table 4, infra, reduction in the activity of the heterotrimeric SNF1 protein kinase in a transgenic PUFA-producing strain of *Yarrowia lipolytica* results in increased total lipid content, relative to a non-transgenic *Yarrowia* whose SNF1 protein kinase activity has not been altered.

Table 4 compiles data from Examples 2-3, 5-10, and 12-14, such that trends concerning the percent increase in total lipid content ["TFAs % DCW"] and the percent increase in EPA productivity ["EPA % DCW"], with respect to control strains, can be deduced. When multiple sets of data are provided for a single strain, this represents results obtained from different growth conditions.

onstrate increased EPA productivity (i.e., an increase in the total PUFA content). EPA production in the particular *Yarrowia* cells utilized in the studies above is the result of the specific genetic engineering within the host cell for PUFA production; in particular, EPA was the desired end product of the introduced functional PUFA biosynthetic pathway, as opposed to PUFA intermediates or by-products. It is expected, for example, that increased ARA productivity [ARA % DCW] would be observed in strains engineered to produce ARA as the desired PUFA product and increased DHA productivity [DHA % DCW] would be observed in strains engineered to produce DHA as the desired PUFA product, if similar reductions in the activity of the heterotrimeric SNF1 protein kinase were performed (according to the methods described herein).

Table 4 above summarizes results obtained when testing 16 different genes that were hypothesized to play a role in the heterotrimeric SNF1 protein kinase network. Of these, only Sip2, Elm1, Hxk1, Acs2, Sks1 and Scs2 did not lead to

TABLE 4

Increased Total Lipid Content And EPA Producitivity In *Yarrowia lipolytica* Strains With Reduced Heterotrimeric SNF1 Protein Kinase Activity

| Example | Means Of Reducing SNF1 Protein Kinase Activity | Strain | % Increase In TFA % DCW Relative To Control Strain | % Increase In EPA % DCW Relative To Control Strain |
|---|---|---|---|---|
| 2 | Down-regulation of Snf1 α-subunit | Y2224 (snf1Δ) | 22% (22 versus 18) | n/a |
|  |  | Y2224 (snf1Δ) | 56% (25 versus 16) | n/a |
| 3 |  | Y4184U (snf1Δ) | 160% (26 versus 10) | 83% (0.68 versus 0.37) |
|  |  | Y4184U (snf1Δ) | 61.5% (21 versus 13) | 13% (3.82 versus 3.37) |
|  |  | Y4184U (snf1Δ) | 133% (28 versus 12) | 50% (0.6 versus 0.4) |
|  |  | Y4184U (snf1Δ) | 60% (24 versus 15) | 53% (5.5 versus 3.6) |
| 5 | Down-regulation of Snf4 γ-subunit | Y4184U (snf4Δ) | 210% (31 versus 10) | 207% (0.92 versus 0.3) |
|  |  | Y4184U (snf4Δ) | 44% (26 versus 18) | 23% (6.10 versus 4.95) |
| 6 | Down-regulation of β-subunit | Y4184U (gal83Δ) | 100% (18 versus 9) | 13% (0.36 versus 0.32) |
|  |  | Y4184U (gal83Δ) | 20% (24 versus 20) | 37% (6.98 versus 5.11) |
|  |  | Y4184U (sip2Δ) | 22% (11 versus 9) | 41% (0.45 versus 0.32) |
|  |  | Y4184U (sip2Δ) | −10% (18 versus 20) | −8% (4.69 versus 5.11) |
| 7 | Down-regulation of upstream regulatory proteins | Y4184U (elm1Δ) | 22% (11 versus 9) | 72% (0.55 versus 0.32) |
|  |  | Y4184U (elm1Δ) | −5% (19 versus 20) | −2% (4.99 versus 5.11) |
|  |  | Y4184U (sak1Δ) | 160% (26 versus 10) | 350% (1.17 versus 0.26) |
|  |  | Y4184U (sak1Δ) | 38% (29 versus 21) | 37% (7.11 versus 5.19) |
| 8 | Up-regulation of upstream regulatory proteins | Y4184U + Reg1 | 67% (30 versus 18) | 60% (7.81 versus 4.89) |
| 9 |  | Y4184U + Hxk1 | 7% (15 versus 14) | −1% (3.99 versus 4.03) |
|  |  | Y4184U + Hxk2 | 26% (29 versus 23) | 20% (7.78 versus 6.47) |
|  |  | Y4184U + Glk1 | 14% (24 versus 21) | 18% (6.86 versus 5.79) |
| 10 | Up-regulation of the regulatory domain of Snf1 α-subunit | Y4184U + Snf1RD | 10% (23 versus 21) | 16% (5.9 versus 5.1) |
|  | Up-regulation of a catalytically inactive Snf1 α-subunit | Y4184U + Snf1 D171A | 13% (27 versus 24) | 21% (7.5 versus 6.2) |
| 12 | Up-regulation of a downstream protein regulated by SNF1 protein kinase | Y4184U + Rme1 | 24% (26 versus 21) | 22% (7.20 versus 5.92) |
| 13 |  | Y4184U + Asc2 | −40% (15 versus 25) | −45% (4.10 versus 7.4) |
|  |  | Y4184U + Sks1 | −21% (19 versus 24) | −20% (5.24 versus 6.51) |
|  |  | Y4184U + Cbr1 | 13% (18 versus 16) | 15% (4.80 versus 4.18) |
|  |  | Y4184U + Scs2 | −13% (21 versus 24) | −15% (5.64 versus 6.49) |
| 14 |  | Y4184U + Snf3 | 14% (25 versus 22) | 14% (6.87 versus 6.04) |

Although data cannot be directly compared between Examples, it is clear that transgenic oleaginous *Yarrowia* comprising a heterotrimeric SNF1 protein kinase having reduced activity result in an increase in total lipid content when compared to the total lipid content of a non-transgenic oleaginous eukaryotic host cell comprising a heterotrimeric SNF1 protein kinase not having reduced activity. Reduction in the activity of the heterotrimeric SNF1 protein kinase can be accomplished via multiple means.

In addition to the increase observed in total lipid content, the transgenic oleaginous *Yarrowia* comprising a heterotrimeric SNF1 protein kinase having reduced activity also demimproved total lipid content in the transgenic host cells. This does not discredit the premise of the present application, whereby it is hypothesized that a reduction in the activity of the heterotrimeric SNF1 protein kinase results in increased total lipid content, as compared to a non-transgenic host cell that does not have reduced activity of the heterotrimeric SNF1 protein kinase. Instead, the negative results obtained above for Sip2, Elm1, Hxk1, Acs2, Sks1 and Scs2 highlight the importance of manipulating the activity of genes that play a significant role in regulating the activity of the heterotrimeric SNF1 protein kinase under the growth conditions in which the particular experiment is being performed. For example, it is known that the Snf1 protein kinase kinases make different contributions to cellular regulation under different conditions, based on work with the *Saccharomyces cerevisiae* Tos3. Particularly, when cells were grown on glycerol-ethanol, tos3Δ reduced growth rate, Snf1 catalytic activity, and activation of the Snf1-dependent carbon source-responsive element ["CSRE"] in the promoters of gluconeogenic genes; in contrast, tos3Δ did not significantly affect Snf1 catalytic activity or CSRE function during abrupt glucose depletion (Kim, M.-D., et al., *Eukaryot Cell.*, 4(5): 861-866 (2005)).

On the basis of the teachings and results described herein, it is expected that the feasibility and commercial utility of reducing the activity of the heterotrimeric SNF1 protein kinase as a means to increase the total lipid content in an oleaginous eukaryotic organism will be appreciated.

EXAMPLES

The present invention is further described in the following Examples, which illustrate reductions to practice of the invention but do not completely define all of its possible variations.

General Methods

Standard recombinant DNA and molecular cloning techniques used in the Examples are well known in the art and are described by: 1) Sambrook, J., Fritsch, E. F. and Maniatis, T., *Molecular Cloning: A Laboratory Manual*; Cold Spring Harbor Laboratory: Cold Spring Harbor, N.Y. (1989) (Maniatis); 2) T. J. Silhavy, M. L. Bennan, and L. W. Enquist, Experiments with Gene Fusions; Cold Spring Harbor Laboratory: Cold Spring Harbor, N.Y. (1984); and 3) Ausubel, F. M. et al., Current Protocols in Molecular Biology, published by Greene Publishing Assoc. and Wiley-Interscience, Hoboken, N.J. (1987).

Materials and methods suitable for the maintenance and growth of microbial cultures are well known in the art. Techniques suitable for use in the following examples may be found as set out in Manual of Methods for General Bacteriology (Phillipp Gerhardt, R. G. E. Murray, Ralph N. Costilow, Eugene W. Nester, Willis A. Wood, Noel R. Krieg and G. Briggs Phillips, Eds), American Society for Microbiology: Washington, D.C. (1994)); or by Thomas D. Brock in Biotechnology: A Textbook of Industrial Microbiology, $2^{nd}$ ed., Sinauer Associates: Sunderland, Mass. (1989). All reagents, restriction enzymes and materials used for the growth and maintenance of microbial cells were obtained from Aldrich Chemicals (Milwaukee, Wis.), DIFCO Laboratories (Detroit, Mich.), New England Biolabs, Inc. (Beverly, Mass.), GIBCO/BRL (Gaithersburg, Md.), or Sigma Chemical Company (St. Louis, Mo.), unless otherwise specified. *E. coli* strains were typically grown at 37° C. on Luria Bertani (LB) plates.

General molecular cloning was performed according to standard methods (Sambrook et al., supra). DNA sequence was generated on an ABI Automatic sequencer using dye terminator technology (U.S. Pat. No. 5,366,860; EP 272,007) using a combination of vector and insert-specific primers. Sequence editing was performed in Sequencher (Gene Codes Corporation, Ann Arbor, Mich.). All sequences represent coverage at least two times in both directions. Unless otherwise indicated herein comparisons of genetic sequences were accomplished using DNASTAR software (DNASTAR Inc., Madison, Wis.).

The meaning of abbreviations is as follows: "sec" means second(s), "min" means minute(s), "h" means hour(s), "d" means day(s), "μL" means microliter(s), "mL" means milliliter(s), "L" means liter(s), "μM" means micromolar, "mM" means millimolar, "M" means molar, "mmol" means millimole(s), "μmole" mean micromole(s), "g" means gram(s), "μg" means microgram(s), "ng" means nanogram(s), "U" means unit(s), "bp" means base pair(s) and "kB" means kilobase(s).

Nomenclature for Expression Cassettes:

The structure of an expression cassette will be represented by a simple notation system of "X::Y::Z", wherein X describes the promoter fragment, Y describes the gene fragment, and Z describes the terminator fragment, which are all operably linked to one another.

Gene Amplification From *Yarrowia lipolytica*:

Unless otherwise specified, PCR amplification of *Yarrowia* genes for the construction of overexpression plasmids pYRH44, pYRH45, pYRH46, pYRH47, pYRH38, pYRH40, pYRH41, pYRH42, pYRH48, pYRH51 and pYRH50 (SEQ ID NOs:89, 95, 96, 97, 110, 112, 122, 123, 124, 125 and 142, respectively) from *Yarrowia lipolytica* was performed using genomic DNA from strain ATCC #20362 as the template and a forward and reverse primer specific for amplification of the desired gene of interest. The reaction mixture included 20 mM Tris-HCl (pH 8.4), 50 mM KCl, 1.5 mM $MgCl_2$, 400 μM each of dGTP, dCTP, dATP and dTTP, 20 μM primer (1 μl of each), 1 μl genomic DNA, 22 μl water and 2 U of Taq polymerase in 50 μl total reaction volume. The thermocycler conditions were: 94° C. for 1 min, followed by 30 cycles of 94° C. for 20 sec, 55° C. for 20 sec and 72° C. for 2 min, followed by a final extension at 72° C. for 7 min.

Transformation and Cultivation Of *Yarrowia lipolytica*

*Yarrowia lipolytica* strain ATCC #20362 was purchased from the American Type Culture Collection (Rockville, Md.). *Yarrowia lipolytica* strains were routinely grown at 28-30° C. in several media, according to the recipes shown below. Agar plates were prepared as required by addition of 20 g/L agar to each liquid media, according to standard methodology.

YPD agar medium (per liter): 10 g of yeast extract [Difco], 20 g of Bacto peptone [Difco]; and 20 g of glucose.

High Glucose Media (HGM) (per liter): 80 glucose, 27 g/L $K_2HPO_4$ 6.3 g/L $KH_2PO_4$.

Synthetic Dextrose Media (SD) (per liter): 6.7 g Yeast Nitrogen base with ammonium sulfate and without amino acids; and 20 g glucose.

Transformation of *Y. lipolytica* was performed as described in U.S. Pat. Appl. Pub. No. 2009-0093543-A1, hereby incorporated herein by reference.

Generation of *Yarrowia lipolytica* Strains Y2224 And Y4184U

Strain Y2224 (a FOA resistant mutant from an autonomous mutation of the Ura3 gene of wildtype *Yarrowia* strain ATCC #20362) was isolated as described in Example 13 of U.S. Pat. App. Pub. No. US2007-0292924, hereby incorporated herein by reference.

Strains Y4184 and Y4184U, producing EPA relative to the total lipids via expression of a Δ9 elongase/Δ8 desaturase pathway, were generated as described in Example 7 of U.S. Pat. App. Pub. No. US2008-0153141, hereby incorporated herein by reference. The development of strain Y4184U, diagrammed in FIG. 3, required the construction of intermediate strains Y2224 (supra), Y4001, Y4001 U, Y4036, Y4036U, Y4069, Y4084, Y4084U1, Y4127 (deposited with the ATCC on Nov. 29, 2007, under accession number ATCC PTA-8802), Y4127U2, Y4158, Y4158U1 and Y4184. Strain Y4184 was capable of producing about 31% EPA relative to the total lipids. The final genotype of strain Y4184 with respect to wildtype *Yarrowia lipolytica* ATCC #20362 was as follows: unknown 1-, unknown 2-, unknown 3-, unknown 4-, unknown 5-, unknown 6-, GPD::FmD12::Pex20, YAT1::FmD12::Oct, GPM/FBAIN::FmD12S::Oct, EXP1::

FmD12S::Aco, YAT1::ME3S::Pex16, EXP1::ME3S::Pex20 (2 copies), GPAT::EgD9e::Lip2, EXP1::EgD9e::Lip1, FBAINm::EgD9eS::Lip2, FBA::EgD9eS::Pex20, YAT1::EgD9eS::Lip2, GPD::EgD9eS::Lip2, GPDIN::EgD8M::Lip1, YAT1::EgD8M::Aco, EXP1::EgD8M::Pex16, FBAINm::EgD8M::Pex20, FBAIN::EgD8M::Lip1 (2 copies), EXP1::EgD5S::Pex20, YAT1::EgD5S::Aco, YAT1::RD5S::Oct, FBAIN::EgD5::Aco, FBAINm::PaD17::Aco, EXP1::PaD17::Pex16, YAT1::PaD17S::Lip1, YAT1::YlCPT1::Aco, GPD::YlCPT1::Aco (wherein FmD12 is a *Fusarium moniliforme* Δ12 desaturase gene [U.S. Pat. No. 7,504,259]; FmD12S is a codon-optimized Δ12 desaturase gene, derived from *Fusarium moniliforme*; ME3S is a codon-optimized $C_{16/18}$ elongase gene, derived from *Mortierella alpina* [U.S. Pat. No. 7,470,532]; EgD9e is a *Euglena gracilis* Δ9 elongase gene [Intl. App. Pub. No. WO 2007/061742]; EgD9eS is a codon-optimized Δ9 elongase gene, derived from *Euglena gracilis* [Intl. App. Pub. No. WO 2007/061742]; EgD8M is a synthetic mutant Δ8 desaturase [Intl. App. Pub. No. WO 2008/073271], derived from *Euglena gracilis* [U.S. Pat. No. 7,256,033]; EgD5 is a *Euglena gracilis* Δ5 desaturase [U.S. Pat. App. Pub. US 2007-0292924-A1]; EgD5S is a codon-optimized Δ5 desaturase gene, derived from *Euglena gracilis* [U.S. Pat. App. Pub. No. 2007-0292924]; RD5S is a codon-optimized Δ5 desaturase, derived from *Peridinium* sp. CCMP626 [U.S. Pat. App. Pub. No. 2007-0271632]; PaD17 is a *Pythium aphanidermatum* Δ17 desaturase [U.S. Pat. No. 7,556,949]; PaD17S is a codon-optimized Δ17 desaturase, derived from *Pythium aphanidermatum* [U.S. Pat. No. 7,556,949]; and, YlCPT1 is a *Yarrowia lipolytica* diacylglycerol cholinephosphotransferase gene [Intl. App. Pub. No. WO 2006/052870]).

Strain Y4184U was then generated by integrating a EXP1::ME3S::Pex20 chimeric gene into the Ura3 gene of strain Y4184, thereby producing a Ura-phenotype.

Fatty Acid Analysis of *Yarrowia lipolytica*

For fatty acid ["FA"] analysis, cells were collected by centrifugation and lipids were extracted as described in Bligh, E. G. & Dyer, W. J. (*Can. J. Biochem. Physiol.*, 37:911-917 (1959)). Fatty acid methyl esters ["FAMES"] were prepared by transesterification of the lipid extract with sodium methoxide (Roughan, G., and Nishida I., *Arch Biochem Biophys.*, 276(1):38-46 (1990)) and subsequently analyzed with a Hewlett-Packard 6890 GC fitted with a 30-m×0.25 mm (i.d.) HP-INNOWAX (Hewlett-Packard) column. The oven temperature was from 170° C. (25 min hold) to 185° C. at 3.5° C./min.

For direct base transesterification, *Yarrowia* culture (1 mL) was harvested. Sodium methoxide (500 µl of 1%) was added to the sample, and then the sample was vortexed and rocked for 60 min. After adding 100 µl of 1 M NaCl and 400 µl hexane, the sample was vortexed and spun. The upper layer was removed and analyzed by GC as described above.

Analysis of Total Lipid Content and Composition in *Yarrowia lipolytica* Under Comparable Oleaginous Conditions For a detailed analysis of the total lipid content and composition in a particular strain of *Yarrowia lipolytica*, flask assays were conducted as followed. Specifically, cultures were grown at a starting $OD_{600nm}$ of ~0.1 in 25 mL SD media in a 125 mL flask for 48 hrs. The cells were harvested by centrifugation for 5 min at 4300 rpm in a 50 mL conical tube. The supernatant was discarded and the calls were resuspended in 25 mL HGM in a new 125 mL flask. After 5 days in a shaker incubator at 250 rpm and at 30° C., a 1 mL aliquot was used for fatty acid analysis (supra) following centrifugation for 1 min at 13,000 rpm and a 5 mL aliguot was dried for dry cell weight ["DCW"] determination.

For DCW determination, 5 mL culture was harvested by centrifugation for 5 min at 4300 rpm. The pellet was resuspended in 10 mL of sterile water and re-harvested as above. The washed pellet was re-suspended in 1 mL of water (three times) and transferred to a pre-weighed aluminum pan. The cell suspension was dried overnight in a vacuum oven at 80° C. The weight of the cells was determined (g/L).

Total lipid content of cells ["TFAs % DCW"] is calculated and considered in conjunction with data tabulating the concentration of each fatty acid as a weight percent of TFAs ["% TFAs"] and the EPA content as a percent of the dry cell weight ["EPA % DCW"], when EPA was produced. Data from flask assays will be presented as a table that summarizes the total dry cell weight of the cells ["DCW'], the total lipid content of cells ["TFAs % DCW"], the concentration of each fatty acid as a weight percent of TFAs ["% TFAs"] and the EPA content as a percent of the dry cell weight ["EPA % DCW"]. More specifically, fatty acids will be identified as 16:0 (palmitate), 16:1 (palmitoleic acid), 18:0 (stearic acid), 18:1 (oleic acid), 18:2 (LA), and EPA.

EXAMPLE 1

Identification of the *Yarrowia lipolytica* Gene Encoding the Snf1 α-Subunit of the Heterotrimeric SNF1 Protein Kinase An ortholog to the *Saccharomyces cerevisiae* serine/threonine protein kinase Snf1 (GenBank Accession No. M13971; SEQ ID NO:2) ["ScSnf1"] was identified in *Yarrowia lipolytica* by conducting BLAST searches using ScSnf1 as the query sequence against the public *Y. lipolytica* protein database of the "Yeast project Genolevures" (Center for Bioinformatics, LaBRI, Talence Cedex, France) (see also Dujon, B. et al., *Nature*, 430 (6995):35-44 (2004)).

One protein sequence, given the designation "YlSnf1", was identified as having substantial homology to ScSnf1. Identity of the *Y. lipolytica* sequence of SEQ ID NO:27 was evaluated by conducting National Center for Biotechnology Information ["NCBI"] BLASTP 2.2.18 (protein-protein Basic Local Alignment Search Tool; Altschul et al., *Nucleic Acids Res.*, 25:3389-3402 (1997); Altschul et al., *FEBS J.*, 272:5101-5109 (2005)) searches for similarity to sequences contained in the BLAST "nr" protein database (comprising all non-redundant GenBank CDS translations, sequences derived from the 3-dimensional structure from Brookhaven Protein Data Bank ["PDB"], sequences included in the last major release of the SWISS-PROT protein sequence database, PIR and PRF excluding those environmental samples from WGS projects) using default parameters (expect threshold=10; word size=3; scoring parameters matrix=BLOSUM62; gap costs: existence=11, extension=1). The results of the BLASTP comparison summarizing the sequence to which SEQ ID NO:27 has the most similarity are reported according to the % identity, % similarity and Expectation value. "% Identity" is defined as the percentage of amino acids that are identical between the two proteins. "% Similarity" is defined as the percentage of amino acids that are identical or conserved between the two proteins. "Expectation value" estimates the statistical significance of the match, specifying the number of matches, with a given score, that are expected in a search of a database of this size absolutely by chance.

Thus, the results of BLASTP searches using the full length amino acid sequence of YlSnf1 (i.e., SEQ ID NO:27) as the query sequence showed that it shared 68% identity and 78% similarity with the *Pichia stipitis* CBS 6054 Snf1 (GenBank Accession No. ABN68104), with an Expectation value of 0.0 (best hit). Additionally, SEQ ID NO:27 shared 60% identity and 71% similarity with the *Saccharomyces cerevisiae* Snf1 (GenBank Accession No. M13971), with an Expectation value of 0.0.

An alignment of YlSnf1 (SEQ ID NO:27) is shown in FIG. 4, along with ScSnf1 (GenBank Accession No. M13971; SEQ ID NO:2), the Snf1 homolog of *Kluyveromyces lactis* ("KlSnf1"; GenBank Accession No. X87975; SEQ ID NO:17), the *Candida albicans* Snf1 ("CaSnf1"; GenBank Accession No. L78129; SEQ ID NO:21), the *Candida tropicalis* Snf1 ("CtSnf1"; GenBank Accession No. AB024535; SEQ ID NO:23) and the *Candida glabrata* Snf1 ("CgSnf1"; GenBank Accession No. L78130; SEQ ID NO:25). The multiple alignment was created using the AlignX program of Vector NTI 9.1.0 (Invitrogen Corp.) and default parameters: gap opening penalty=10; gap extension penalty=0.05; gap separation penalty=8; transition weighting=0). The N-terminal activation-loop segment spanning the conserved "DFG" and "APE" motifs is shown on the Figure in a box.

EXAMPLE 2

Figures 5A, 5B:
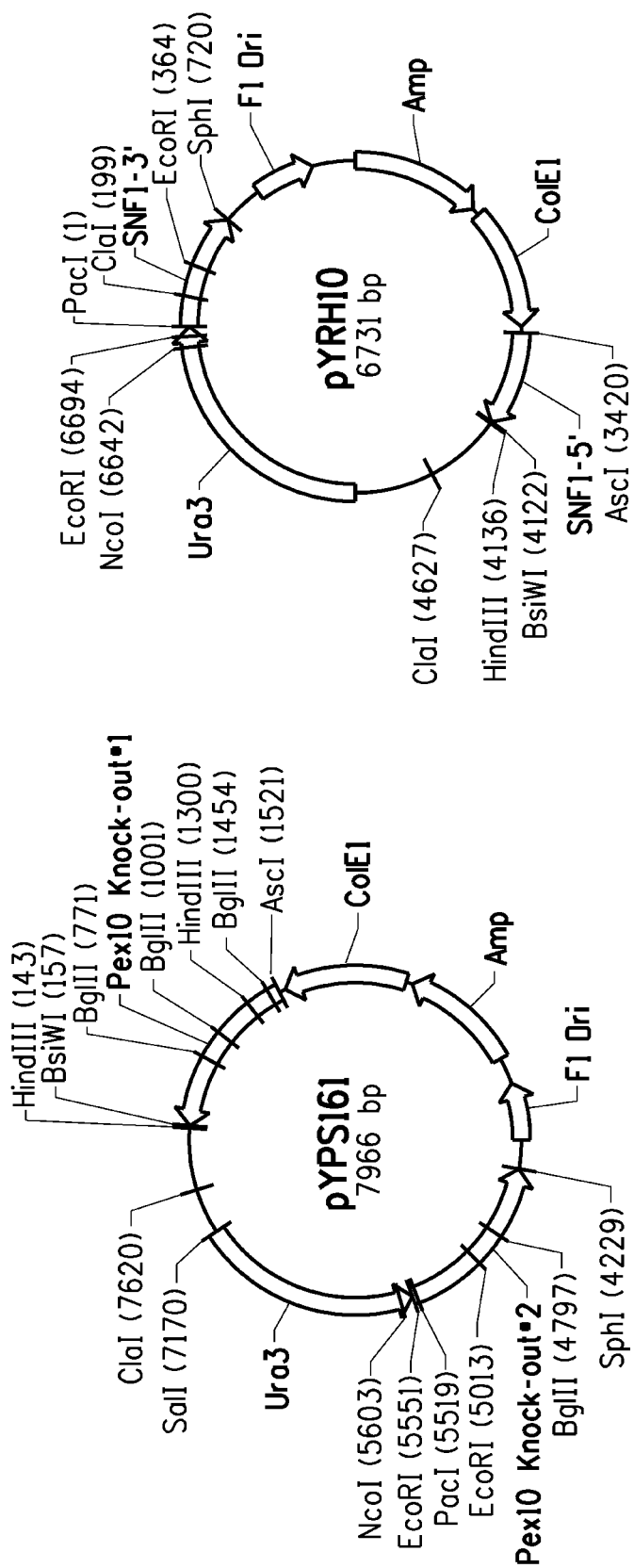

Deletion of the Gene Encoding the Snf1 α-Subunit of the Heterotrimeric SNF1 Protein Kinase in *Yarrowia lipolytica* Strain Y2224 Increases Total Accumulated Lipid Level and Lipid Desaturation The present Example describes use of construct PYRH10 (FIG. 5B; SEQ ID NO:39) to knock out the chromosomal SNF1 gene from *Yarrowia lipolytica* strain Y2224, thereby producing strain Y2224 (snf1Δ). The effect of the Snf1 knockout on accumulated lipid level was determined and compared. Specifically, knockout of Snf1 resulted in increased total lipid (measured as percent of the total dry cell weight ["TFAs % DCW"]) and lipid desaturation in the cell, as compared to cells whose native Snf1 had not been knocked out.

Construction Of pYRH10 (SEQ ID NO:39): Plasmid pYRH10 (SEQ ID NO:39) was derived from plasmid pYPS161 (FIG. 5A; SEQ ID NO:40), which contained the following components:

TABLE 5

Description of Plasmid pYPS161 (SEQ ID NO: 40)

| RE Sites And Nucleotides Within SEQ ID NO: 40 | Description Of Fragment And Chimeric Gene Components |
|---|---|
| AscI/BsiWI (1521-157) | 1364 bp PEX10 knockout fragment #1 of *Yarrowia* PEX10 gene (GenBank Accession No. AB036770) |
| PacI/SphI (5519-4229) | 1290 bp PEX10 knockout fragment #2 of *Yarrowia* PEX10 gene (GenBank Accession No. AB036770) |
| SalI/EcoRI (7170-5551) | *Yarrowia* URA3 gene (GenBank Accession No. AJ306421) |
| 2451-1571 | ColE1 plasmid origin of replication |
| 3369-2509 | ampicillin-resistance gene (Amp$^R$) for selection in *E. coli* |
| 3977-3577 | *E. coli* f1 origin of replication |

Specifically, a 702 bp 5' promoter region (SEQ ID NO:41) of the *Yarrowia lipolytica* SNF1 gene ("YlSNF1"; SEQ ID NO:26) replaced the AscI/BsiWI fragment of pYPS161 (SEQ ID NO:40) and a 719 bp 3' terminator region (SEQ ID NO:42) of the YlSNF1 gene replaced the PacI/SphI fragment of pYPS161 to produce pYRH10 (SEQ ID NO:39; FIG. 5B).

Generation Of *Yarrowia lipolytica* Knockout Strain Y2224 (snf1Δ): *Yarrowia lipolytica* strain Y2224 was transformed with the purified 4.0 kB AscI/SphI fragment of SNF1 knockout construct PYRH10 (SEQ ID NO:39) (General Methods).

To screen for cells having the snf1 deletion, colony PCR was performed using Taq polymerase (Invitrogen; Carlsbad, Calif.), and two different sets of PCR primers. The first set of PCR primers (i.e., SNF1 Fii [SEQ ID NO:43] and SNF1 Rii [SEQ ID NO:44]) was designed to amplify a 1.8 kB region of the intact YlSNF1 gene, and therefore a snf1 deleted mutant, i.e., snf1Δ, would not produce the band. The second set of primers was designed to produce a band only when the SNF1 gene was deleted. Specifically, one primer (i.e., 3UTR-URA3; SEQ ID NO:45) binds to a region in the vector sequences of the introduced 4.0 kB AscI/SphI disruption fragment, and the other primer (i.e., 3R-SNF1; SEQ ID NO:46) binds to chromosomal SNF1 terminator sequences outside of the homologous region of the disruption fragment.

The colony PCR was performed using a reaction mixture that contained: 20 mM Tris-HCl (pH 8.4), 50 mM KCl, 1.5 mM MgCl$_2$, 400 μM each of dGTP, dCTP, dATP and dTTP, 2 μM each of the primers, 20 μl water and 2 U Taq polymerase. Amplification was carried out as follows: initial denaturation at 94° C. for 2 min, followed by 35 cycles of denaturation at 94° C. for 1 min, annealing at 55° C. for 1 min, and elongation at 72° C. for 2 min. A final elongation cycle at 72° C. for 5 min was carried out, followed by reaction termination at 4° C.

Of 24 colonies screened, 23 had the snf1 knockout fragment integrated at a random site in the chromosome and thus were not snf1Δ mutants; however, the cells could grow on ura-plates, due to the presence of the PYRH10 fragment. Two of these random integrants, designated as 2224-1 and 2224-2, were used as controls in lipid production experiments (Table 6, infra).

One of the colonies screened was the snf1 knockout. This *Y. lipolytica* snf1Δ mutant of Y2224 was designated RHY11.

Confirmation Of *Yarrowia lipolytica* Knockout Strain Y2224 (snf1Δ) By Quantitative Real Time PCR: Further confirmation of the snf1 knockout in strain RHY11 was performed by quantitative real time PCR on YlSNF1, with the *Yarrowia* translation elongation factor gene TEF1 (GenBank Accession No. AF054510) used as the control.

First, real time PCR primers and TaqMan probes targeting the YlSNF1 gene and the control TEF1 gene, respectively, were designed with Primer Express software v 2.0 (Applied-Biosystems, Foster City, Calif.). Specifically, real time PCR primers ef-324F (SEQ ID NO:47), ef-392R (SEQ ID NO:48), SNF-734F (SEQ ID NO:49) and SNF-796R (SEQ ID NO:50) were designed, as well as the TaqMan probes ef-345T (i.e., 5' 6-FAM™-TGCTGGTGGTGTTGGTGAGTT-TAMRA™, wherein the nucleotide sequence is set forth as SEQ ID NO:51) and SNF-756T (i.e., 5' 6-FAM™-TGCCGGCG-CAAAACACCTG-TAMRA™, wherein the nucleotide sequence is set forth as SEQ ID NO:52). The 5' end of the TaqMan fluorogenic probes have the 6-FAM™ fluorescent reporter dye bound, while the 3' end comprises the TAMRA™ quencher. All primers and probes were obtained from Sigma-Genosys (Woodlands, Tex.).

Knockout candidate DNA was prepared by suspending 1 colony in 50 μl of water. Reactions for TEF1 and YlSNF1 were run separately in triplicate for each sample. Real time PCR reactions included 20 pmoles each of forward and reverse primers (i.e., ef-324F, ef-392R, SNF-734F and SNF-796R, supra), 5 pmoles TaqMan probe (i.e., ef-345T and SNF-756T, supra), 10 μl TaqMan Universal PCR Master Mix—No AmpErase® Uracil-N-Glycosylase (UNG) (Catalog No. PN 4326614, Applied Biosystems), 1 μl colony suspension and 8.5 μl RNase/DNase free water for a total volume of 20 μl per reaction. Reactions were run on the ABI PRISM®

7900 Sequence Detection System under the following conditions: initial denaturation at 95° C. for 10 min, followed by 40 cycles of denaturation at 95° C. for 15 sec and annealing at 60° C. for 1 min. Real time data was collected automatically during each cycle by monitoring 6-FAM™ fluorescence. Data analysis was performed using TEF1 gene threshold cycle ($C_T$) values for data normalization as per the ABI PRISM® 7900 Sequence Detection System instruction manual.

Based on this analysis, it was concluded that RHY11 was a valid Snf1 knockout (i.e., snf1Δ), wherein the pYRH10 construct (SEQ ID NO:39) had integrated into the chromosomal YlSNF1.

Evaluation Of *Yarrowia lipolytica* Strains ATCC #20362 And Y2224 (snf1Δ) For Lipid Production: To evaluate the effect of the Snf1 knockout on the percent of PUFAs in the total lipid fraction and the total lipid content in the cells, *Y. lipolytica* ATCC #20362 and Y2224 (snf1Δ) strain RHY11 were grown under comparable oleaginous conditions (General Methods).

The DCW, total lipid content of cells ["TFAs % DCW"] and the concentration of each fatty acid as a weight percent of TFAs ["% TFAs"] for each strain is shown below in Table 6, while averages are highlighted in gray and indicated with "Ave".

TABLE 6

Lipid Composition In *Y. lipolytica* Strains ATCC #20362 And Y2224 (snf1Δ)

| Strain | Sample | DCW (g/L) | TFAs % DCW | 16:0 | 16:1 | 18:0 | 18:1 | 18:2 |
|---|---|---|---|---|---|---|---|---|
| ATCC #20362 | 1 | 9.00 | 19 | 12.2 | 14.4 | 5.3 | 54.9 | 11.3 |
| | 2 | 9.30 | 18 | 12.2 | 14.4 | 5.4 | 55.6 | 11.2 |
| | 3 | 9.40 | 18 | 12.1 | 14.4 | 5.4 | 55.8 | 11.2 |
| | 4 | 9.38 | 18 | 12.2 | 14.7 | 5.2 | 55.5 | 11.3 |
| | AVE | 9.28 | 18 | 12.2 | 14.5 | 5.3 | 55.5 | 11.3 |
| Y2224 (snf1Δ) | RHY11-1 | 4.24 | 23 | 8.8 | 17.3 | 2.9 | 47.2 | 21.8 |
| | RHY11-2 | 4.14 | 23 | 8.8 | 17.3 | 2.8 | 47.1 | 21.9 |
| | RHY11-3 | 4.16 | 22 | 8.8 | 17.1 | 2.9 | 46.9 | 22.0 |
| | RHY11-4 | 4.44 | 20 | 8.6 | 17.2 | 2.8 | 47.5 | 21.7 |
| | AVE | 4.25 | 22 | 8.8 | 17.2 | 2.9 | 47.2 | 21.9 |

The results in Table 6 showed that knockout of the chromosomal snf1 gene in Y2224 (snf1Δ) increased the lipid content ["TFAs % DCW"] by 22%, as compared to that of ATCC #20362 whose native Snf1 had not been knocked out. Also, the ratio of desaturated fatty acids (16:1, 18:1, 18:2) to saturated fatty acids (16:0, 18:0) increased approximately 60% in the snf1Δ strain, RHY11.

Evaluation Of *Yarrowia lipolytica* Strains Y2224 (Ura+) And Y2224 (snf1Δ) For Lipid Production: To evaluate the effect of the Snf1 knockout on the percent of PUFAs in the total lipid fraction and the total lipid content in the cells, the SNF1 wild type strains having the SNF1 knockout fragment integrated at a random site in the chromosome (i.e., *Y. lipolytica* Y2224 (Ura+) strains 2224-1 and 2224-2) and the *Y. lipolytica* Y2224 (snf1Δ) strain (i.e., RHY11) were grown under comparable oleaginous conditions; however, the culture collection method was modified with respect to that used above for *Y. lipolytica* strains ATCC #20362 and Y2224 (snf1Δ). Specifically, after 2 days growth in SD media, a similar cell mass of Y2224 (Ura+) and Y2224 (snf1Δ) cultures (judged by $OD_{600}$ of culture) was transferred to HGM to reach a similar final DCW (g/L) at the end of 5 days incubation in HGM.

DCW and lipid content were determined as previously described.

The DCW, total lipid content of cells ["TFAs % DCW"] and the concentration of each fatty acid as a weight percent of TFAs ["% TFAs"] for each strain is shown below in Table 7, while averages are highlighted in gray and indicated with "Ave".

TABLE 7

Lipid Composition In *Y. lipolytica* Strains Y2224 (Ura+) And Y2224 (snf1Δ)

| Strain | Sample | DCW (g/L) | TFAs % DCW | 16:0 | 16:1 | 18:0 | 18:1 | 18:2 |
|---|---|---|---|---|---|---|---|---|
| Y2224 (Ura+) | 2224-1 | 2.94 | 16 | 13.0 | 16.9 | 4.7 | 43.6 | 18.6 |
| | 2224-2 | 2.76 | 16 | 13.1 | 16.9 | 4.7 | 44.2 | 18.0 |
| | AVE | 2.85 | 16 | 13.1 | 16.9 | 4.7 | 43.9 | 18.3 |
| Y2224 (snf1Δ) | RHY11-1 | 3.14 | 26 | 8.8 | 16.2 | 2.9 | 47.1 | 21.2 |
| | RHY11-2 | 3.22 | 24 | 8.6 | 16.8 | 2.7 | 46.3 | 21.9 |
| | AVE | 3.18 | 25 | 8.7 | 16.5 | 2.8 | 46.7 | 21.6 |

Similar to the results described in Table 6 above, the results in Table 7 showed that knockout of the chromosomal SNF1 gene in Y2224 (snf1Δ) increased the lipid content ["TFAs % DCW"] by over 50%, as compared to that of Y2224 (Ura+) whose native Snf1 had not been knocked out. The ratio of desaturated fatty acids (16:1, 18:1, 18:2) to saturated fatty acids (16:0, 18:0) increased over 60% in the snf1Δ mutant, RHY11.

EXAMPLE 3

Deletion of the Gene Encoding the Snf1 α-Subunit of the Heterotrimeric SNF1 Protein Kinase in EPA Producing *Yarrowia lipolytica* Strain Y4184U Increases Total Accumulated Lipid Level and Lipid Desaturation The present Example describes the use of construct pYRH18 (FIG. 6; SEQ ID NO:53) to knock out the chromosomal SNF1 gene from an EPA producing engineered strain of *Yarrowia lipolytica*, specifically, strain Y4184U. Transformation of *Y. lipolytica* strain Y4184U with the SNF1 knockout construct fragment resulted in strain Y4184U (snf1Δ). The effect of the Snf1 knockout on accumulated lipid level and EPA production was determined and compared. Specifically, knockout of SNF1 resulted in increased total lipid and lipid desaturation, as compared to cells whose native Snf1 had not been knocked out.

Construct pYRH18 (SEQ ID NO:53): Plasmid pYRH18 (SEQ ID NO:53) was derived from plasmid pYRH10 (Example 2, SEQ ID NO:39). First, a 1448 bp 5' promoter region (SEQ ID NO:54) of the YlSNF1 gene (SEQ ID NO:26) replaced the AscI/Bs/WI fragment of pYRH10 (SEQ ID NO:39), which comprised a 702 bp 5' promoter region of YlSNF1, thereby creating a longer region of homology to facilitate integration. Then, a 1.6 kB fragment comprising the *Yarrowia* URA3 gene (GenBank Accession No. AJ306421) flanked by loxP recombinase recognition sites (excised from plasmid pYLoxU-ECH (SEQ ID NO:58)) was used to replace the BsiWI/SphI fragment of pYRH10 (SEQ ID NO:39). This resulted in production of pYRH18 (SEQ ID NO:53; FIG. 6).

Generation Of *Yarrowia lipolytica* Knockout Strain Y4184U (snf1Δ): *Yarrowia lipolytica* strain Y4184U was transformed with the purified 3.9 kB AscI/SphI fragment of Snf1 knockout construct pYRH18 (SEQ ID NO:53) (General Methods). Strain Y4184U (snf1Δ) was isolated using the methodologies described in Example 2.

Of 78 colonies screened by colony PCR, 55 had the SNF1 knockout fragment integrated at a random site in the chromosome and thus were not snf1Δ mutants; however, the cells could grow on plates lacking uracil due to the presence of the pYRH18 (SEQ ID NO:53) fragment. Eight of these random integrants, designated as Cont-1 through Cont-8, were used as controls in lipid production experiments (infra, Tables 8-10 and 12-16).

The remaining 23 colonies contained the snf1 knockout within the Y4184U strain background. Among these 23 snf1Δ mutants, 11 were randomly chosen for further lipid analyses and designated as RHY43 through RHY53. Further confirmation of the Snf1 knockout in the snf1Δ strains was performed by quantitative real time PCR on the YlSNF1 gene, as described in Example 2.

Evaluation Of *Yarrowia lipotytica* Strains Y4184U (Ura+) And Y4184U (snf1Δ) For Lipid Production: To evaluate the effect of the Snf1 knockout on total lipid content and FA composition, select *Y. lipolytica* Y4184U (Ura+) and Y4184U (snf1Δ) strains (i.e., control strains Cont-1, Cont-2 and Cont-3, and snf1Δ mutant strains RHY43 through RHY53) were grown under comparable oleaginous conditions, as described in the General Methods. The only exception to the methodology therein was that mL of the cell cultures were collected by centrifugation after 2 days in SD, to enable determination of lipid content.

The DCW, total lipid content of cells ["TFAs % DCW"] and the concentration of each fatty acid as a weight percent of TFAs ["% TFAs"] for each strain is shown below in Table 8, while averages are highlighted in gray and indicated with "Ave".

TABLE 8

Lipid Composition In *Y. lipolytica* Strains Y4184U (Ura+) And Y4184U (snf1Δ)

| Strain and Growth Condition | Sample | DCW (g/L) | TFAs % DCW | % TFAs 18:0 Stearic | 18:1 Oleic | 18:2 Linoleic | 20:2 EDA | 20:5 EPA |
|---|---|---|---|---|---|---|---|---|
| Y4184U (Ura+): 2 Days in SD | Cont-1 | 2.04 | 10 | 1.5 | 3.2 | 36.6 | 15.8 | 5.4 |
|  | Cont-2 | 2.76 | 10 | 2.6 | 4.2 | 37.8 | 20.2 | 2.5 |
|  | Cont-3 | 2.32 | 11 | 2.2 | 4.6 | 38.3 | 18.0 | 3.1 |
|  | AVE | 2.37 | 10 | 2.1 | 4.0 | 37.6 | 18.0 | 3.7 |
| Y4184U (snf1Δ): 2 Days in SD | RHY43 | 3.28 | 33 | 4.2 | 18.4 | 32.4 | 12.5 | 1.7 |
|  | RHY44 | 2.84 | 26 | 3.2 | 18.9 | 30.3 | 11.3 | 2.8 |
|  | RHY45 | 2.70 | 27 | 3.1 | 19.7 | 32.9 | 11.7 | 1.8 |
|  | RHY46 | 3.00 | 36 | 4.0 | 18.4 | 32.4 | 13.7 | 1.7 |
|  | RHY47 | 3.90 | 33 | 4.0 | 17.5 | 31.9 | 12.2 | 1.5 |
|  | RHY48 | 0.88 | 16 | 2.0 | 15.6 | 36.5 | 9.0 | 6.0 |
|  | RHY49 | 2.22 | 22 | 2.8 | 18.9 | 33.9 | 10.7 | 2.5 |
|  | RHY50 | 2.76 | 26 | 2.1 | 22.8 | 30.0 | 10.1 | 3.1 |
|  | RHY51 | 2.52 | 20 | 2.4 | 19.7 | 32.1 | 10.3 | 3.0 |
|  | RHY52 | 2.62 | 23 | 2.9 | 19.2 | 33.3 | 10.9 | 2.5 |
|  | RHY53 | 2.76 | 28 | 2.6 | 20.9 | 32.1 | 12.1 | 1.9 |
|  | AVE | 2.68 | 26 | 3.0 | 19.1 | 32.5 | 11.3 | 2.6 |
| Y4184U (Ura+): 5 Days in HGM | Cont-1 | 3.60 | 13 | 2.7 | 5.0 | 25.4 | 4.3 | 30.5 |
|  | Cont-2 | 4.46 | 12 | 1.9 | 5.3 | 33.3 | 6.1 | 24.0 |
|  | Cont-3 | 3.88 | 14 | 2.4 | 5.3 | 31.4 | 4.9 | 23.3 |
|  | AVE | 3.98 | 13 | 2.3 | 5.2 | 30.0 | 5.1 | 25.9 |
| Y4184U (snf1Δ): 5 Days in HGM | RHY43 | 5.92 | 23 | 2.0 | 10.9 | 30.9 | 8.2 | 20.9 |
|  | RHY44 | 4.88 | 23 | 2.1 | 12.3 | 29.3 | 7.9 | 18.9 |
|  | RHY45 | 4.82 | 22 | 2.1 | 11.5 | 31.7 | 8.1 | 16.2 |
|  | RHY46 | 5.90 | 25 | 1.5 | 8.4 | 29.9 | 8.6 | 24.2 |
|  | RHY47 | 7.00 | 18 | 1.4 | 8.0 | 29.7 | 7.2 | 24.9 |
|  | RHY48 | 2.62 | 16 | 2.4 | 10.7 | 29.9 | 6.6 | 18.5 |
|  | RHY49 | 3.56 | 25 | 2.1 | 10.5 | 31.3 | 7.0 | 19.8 |
|  | RHY50 | 3.60 | 19 | 2.1 | 13.9 | 30.2 | 8.7 | 11.7 |
|  | RHY51 | 3.96 | 18 | 2.4 | 11.6 | 30.6 | 8.1 | 14.3 |
|  | RHY52 | 4.10 | 17 | 2.4 | 10.8 | 31.3 | 8.0 | 16.1 |
|  | RHY53 | 4.28 | 21 | 2.1 | 13.2 | 31.3 | 8.6 | 15.1 |
|  | AVE | 4.6 | 21 | 2.1 | 11.1 | 30.6 | 7.9 | 18.2 |

The results in Table 8 showed that knockout of the chromosomal snf1 gene in Y4184U (snf1Δ) increased the lipid content ["TFAs % DCW"] by 160% after 2 days culturing in SD media and by approximately 61% after 5 days incubation in HGM, as compared to that of strain Y4184U (Ura+) whose native Snf1 had not been knocked out. There are also significant increases in desaturated 18:1 and 18:2 fatty acids in snf1Δ mutants both after 2 days in SD media and 5 days in HGM, as compared to saturated 18:0 fatty acids. The increase in fatty acid desaturation in snf1Δ strains is consistent with the results in Example 2.

Those Y4184U (snf1Δ) strains above producing the greatest average EPA % TFAs at the end of 5 days in HGM, which were strains RHY43, RHY44, RHY46, RHY47 and RHY49, as well as RHY48, were grown again in duplicate, as described above, along with cultures of Cont-3, Cont-4, Cont-5, Cont-6, Cont-7 and Cont-8. Cultures were analyzed as previously described and results are shown in Table 9. EPA % DCW was also determined.

TABLE 9

Lipid Composition In *Y. lipolytica* Strains Y4184U (Ura+) And Y4184U (snf1Δ)

| Strain and Growth Condition | Sample | TFAs DCW (g/L) | % DCW | % TFAs 18:0 Stearic | 18:1 Oleic | 18:2 Linoleic | 20:2 EDA | 20:5 EPA | EPA % DCW |
|---|---|---|---|---|---|---|---|---|---|
| Y4184U (Ura+): | Cont-3 | 1.70 | 11 | 1.8 | 5.1 | 39.6 | 16.8 | 3.2 | 0.4 |
| 2 Days in SD | Cont-4 | 2.40 | 13 | 3.2 | 1.6 | 37.9 | 20.4 | 2.4 | 0.3 |
|  | Cont-5 | 2.32 | 12 | 2.2 | 4.2 | 37.2 | 21.0 | 2.6 | 0.3 |
|  | Cont-6 | 2.50 | 12 | 2.4 | 2.9 | 35.1 | 19.4 | 4.7 | 0.6 |
|  | Cont-7 | 2.04 | 11 | 2.8 | 4.0 | 38.8 | 18.5 | 3.4 | 0.4 |
|  | Cont-8 | 1.68 | 12 | 2.0 | 3.8 | 39.0 | 17.8 | 4.0 | 0.5 |
|  | AVE | 2.1 | 12 | 2.4 | 3.6 | 37.9 | 19.0 | 3.4 | 0.4 |
| Y4184U (snf1Δ): | RHY43-1 | 2.50 | 35 | 4.0 | 18.1 | 32.9 | 13.0 | 1.4 | 0.5 |
| 2 Days in SD | RHY43-2 | 2.90 | 34 | 4.0 | 18.2 | 32.3 | 12.9 | 1.5 | 0.5 |
|  | RHY44-1 | 2.50 | 26 | 3.1 | 18.6 | 31.3 | 10.8 | 2.5 | 0.6 |
|  | RHY44-2 | 2.16 | 22 | 2.6 | 18.2 | 32.0 | 10.8 | 3.7 | 0.8 |
|  | RHY45-1 | 2.78 | 29 | 3.0 | 20.3 | 32.8 | 11.8 | 1.7 | 0.5 |
|  | RHY45-2 | 2.40 | 29 | 3.0 | 19.5 | 33.1 | 12.2 | 1.7 | 0.5 |
|  | RHY46-1 | 2.54 | 28 | 3.8 | 17.9 | 33.7 | 12.5 | 1.9 | 0.5 |
|  | RHY46-2 | 2.18 | 31 | 3.7 | 17.7 | 34.0 | 13.6 | 2.1 | 0.7 |
|  | RHY47-1 | 2.94 | 36 | 3.9 | 18.2 | 32.1 | 13.7 | 1.3 | 0.5 |
|  | RHY47-2 | 2.58 | 34 | 4.0 | 17.8 | 32.6 | 13.5 | 1.5 | 0.5 |
|  | RHY49-1 | 1.46 | 17 | 2.0 | 16.5 | 36.5 | 11.3 | 4.1 | 0.7 |
|  | RHY49-2 | 1.72 | 19 | 2.3 | 17.8 | 35.7 | 11.2 | 3.2 | 0.6 |
|  | AVE | 2.38 | 28 | 3.3 | 18.2 | 33.3 | 12.3 | 2.2 | 0.6 |
| Y4184U (Ura+): | Cont-3 | 2.64 | 16 | 2.6 | 5.7 | 29.8 | 4.3 | 25.0 | 3.9 |
| 5 Days in HGM | Cont-4 | 3.16 | 14 | 2.4 | 5.4 | 33.6 | 5.5 | 21.1 | 3.0 |
|  | Cont-5 | 3.62 | 12 | 2.0 | 5.0 | 32.2 | 5.3 | 24.0 | 2.9 |
|  | Cont-6 | 4.86 | 16 | 2.1 | 5.4 | 31.1 | 4.7 | 27.5 | 4.3 |
|  | Cont-7 | 4.12 | 17 | 1.9 | 6.0 | 32.0 | 5.0 | 26.7 | 4.5 |
|  | Cont-8 | 3.48 | 12 | 2.1 | 5.9 | 31.2 | 4.8 | 25.9 | 3.2 |
|  | AVE | 3.65 | 15 | 2.2 | 5.6 | 31.7 | 4.9 | 25.0 | 3.6 |
| Y4184U (snf1Δ): | RHY43-1 | 4.34 | 24 | 1.9 | 10.6 | 30.1 | 7.5 | 22.7 | 5.4 |
| 5 Days in HGM | RHY43-2 | 5.16 | 24 | 1.9 | 9.5 | 30.2 | 7.7 | 22.1 | 5.4 |
|  | RHY44-1 | 3.62 | 24 | 1.9 | 10.8 | 29.0 | 7.3 | 20.9 | 5.0 |
|  | RHY44-2 | 4.08 | 24 | 1.9 | 10.5 | 29.2 | 7.0 | 21.7 | 5.1 |
|  | RHY45-1 | 4.00 | 23 | 2.0 | 11.6 | 31.4 | 7.8 | 17.1 | 3.9 |
|  | RHY45-2 | 4.32 | 25 | 2.0 | 11.4 | 31.2 | 7.6 | 17.8 | 4.4 |
|  | RHY46-1 | 4.72 | 27 | 1.4 | 8.0 | 29.6 | 7.6 | 26.7 | 7.2 |
|  | RHY46-2 | 4.94 | 29 | 1.4 | 7.9 | 29.7 | 7.2 | 27.2 | 8.0 |
|  | RHY47-1 | 4.92 | 26 | 1.5 | 8.0 | 28.8 | 6.7 | 26.3 | 6.7 |
|  | RHY47-2 | 5.44 | 19 | 1.6 | 8.2 | 29.3 | 6.6 | 25.5 | 4.9 |
|  | RHY49-1 | 2.08 | 23 | 1.9 | 9.1 | 30.4 | 5.7 | 22.7 | 5.3 |
|  | RHY49-2 | 3.08 | 20 | 1.9 | 9.6 | 31.4 | 6.3 | 22.0 | 4.5 |
|  | AVE | 4.23 | 24 | 1.8 | 9.6 | 30.0 | 7.1 | 22.7 | 5.5 |

The results in Table 9 showed that the average lipid content ["TFAs % DCW"] for Y4184U (snf1Δ) strains was increased by approximately 133% after 2 days in SD media and by 60% after 5 days in HGM compared to that of the control Y4184U (Ura+) strains. Y4184U (snf1Δ) strains also showed significant increases in desaturated 18-C fatty acids (18:1, 18:2) in snf1Δ mutants both after 2 days in SD media and 5 days in HGM, consistent with the results in Table 8. The increase in fatty acid desaturation in snf1Δ strains is also consistent with the results in Example 2.

The total EPA % TFAs for the Y4184U (snf1Δ) strains was comparable to those of controls (Table 8). However, due to the significant increase in total lipid content, the Y4184U (snf1Δ) strains exhibited over 50% higher EPA productivity ["EPA % DCW"] on average than that of the controls.

EXAMPLE 4

Time Course Experiments for Total Lipid and PUFA Production of *Yarrowia lipolytica* Strains Y2224 (snf1Δ) and Y4184U (snf1Δ)

The present Example describes time course experiments that were performed with a Y2224 (snf1Δ) strain (i.e., strain RHY11 from Example 2) and a Y4184U (snf1Δ) strain (i.e., strain RHY46 from Example 3), to gain additional insights into the patterns of oil synthesis of snf1Δ mutants.

Samples of each snf1Δ strain and a suitable control were taken for lipid analysis at either 6 or 7 different time points over each time course experiment. Thus, the following cultures were initially inoculated in SD medium to get a starting $OD_{600}$ of ~0.1 in a total culture volume of 175 mL: *Y. lipolytica* ATCC #20362, Y2224 (snf1Δ) strain RHY11, Y4184U (Ura+) cont-4 (Example 3) and Y4184U (snf1Δ) strain RHY46. Each cell culture was then divided into seven aliquots (25 mL each) in 125 mL flasks. After incubating all cultures with aeration for 48 hrs at 30° C., the first time point (day 0) sample (25 mL) was taken for DCW and lipid analysis, as described below. The remaining total volume of each 150 mL culture was then combined, and harvested by centrifugation for 5 min at 4300 rpm in a 250 mL tube. The supernatant was discarded, and the cells were re-suspended in 150 mL of HGM and transferred to new six 125 mL flasks with 25 mL each. The cells were then incubated with aeration for up to 168 hrs at 30° C. At each time point, one 25 mL *Y. lipolytica* ATCC #20362 culture, one 25 mL Y2224 (snf1Δ) strain RHY11 culture, one 25 mL Y4184U (Ura+) Cont-4 culture and one 25 mL Y4184U (snf1Δ) strain RHY46 culture was used for lipid analysis.

DCW was determined according to the General Methods, using cells from either 5 mL of the SD- or HGM-grown cultures.

Lipid content was determined according to the General Methods, using cells from either 1 mL of the SD- or HGM-grown cultures.

The DCW, total lipid content of cells ["TFAs % DCW"] and the concentration of each fatty acid as a weight percent of TFAs ["% TFAs"] over the 7 day time course for ATCC #20362 and Y2224 (snf1Δ) are shown below in Table 10, while comparable results are shown for Y4184U (Ura+) and Y4184U (snf1Δ) in Table 11. Similarly, results are graphically shown over each time course for ATCC #20362 and Y2224 (snf1Δ) in FIG. 7A and for Y4184U (Ura+) and Y4184U (snf1Δ) in FIG. 7B.

TABLE 10

Time Course For Lipid Content And Composition In *Y. lipolytica* Strains ATCC #20362 And Y2224 (snf1Δ)

| Strain | Time (days in HGM) | DCW (g/L) | TFAs % DCW | % TFAs 16:0 | 16:1 | 18:0 | 18:1 | 18:2 |
|---|---|---|---|---|---|---|---|---|
| Control | 0 | 1.28 | 7 | 15.1 | 6.1 | 4.7 | 51.1 | 20.2 |
| (ATCC | 2 | 2.16 | 12 | 18.9 | 12.6 | 6.9 | 44.8 | 14.5 |
| #20362) | 3 | 2.34 | 16 | 18.4 | 13.6 | 6.8 | 44.7 | 14.6 |
|  | 4 | 2.28 | 14 | 17.7 | 12.7 | 6.1 | 44.0 | 15.3 |
|  | 5 | 2.16 | 15 | 16.1 | 12.8 | 5.4 | 44.5 | 15.5 |
|  | 7 | 2.24 | 14 | 13.5 | 12.9 | 4.5 | 46.3 | 16.7 |
| Y2224 | 0 | 1.86 | 19 | 13.4 | 6.9 | 4.1 | 54.6 | 16.4 |
| (snf1Δ) | 2 | 2.98 | 16 | 12.5 | 9.7 | 6.6 | 50.5 | 18.4 |
| (RHY11) | 3 | 3.14 | 18 | 11.4 | 10.3 | 6.3 | 50.4 | 19.4 |
|  | 4 | 2.94 | 19 | 10.3 | 8.9 | 5.4 | 50.8 | 20.1 |
|  | 5 | 2.94 | 18 | 9.3 | 9.3 | 4.7 | 51.0 | 20.8 |
|  | 7 | 3.26 | 17 | 8.2 | 9.8 | 4.1 | 50.9 | 21.3 |

TABLE 11

Time Course For Lipid Content And Composition In *Y. lipolytica* Strains Y4184U (Ura+) And Y4184U (snf1Δ)

| Strains | Time (days in HGM) | DCW (g/L) | TFAs % DCW | % TFAs 18:0 | 18:1 | 18:2 | 20:2 EDA | 20:5 EPA | EPA % DCW |
|---|---|---|---|---|---|---|---|---|---|
| Y4184U | 0 | 1.92 | 14 | 2.7 | 1.3 | 34.0 | 17.3 | 0.7 | 0.1 |
| (Ura+) | 1 | 2.36 | 16 | 2.9 | 8.2 | 33.6 | 5.0 | 17.3 | 2.7 |
| (Cont-4) | 2 | 2.46 | 22 | 2.8 | 8.4 | 32.5 | 4.5 | 20.9 | 4.6 |
|  | 3 | 2.52 | 24 | 2.8 | 7.1 | 32.0 | 4.3 | 22.8 | 5.6 |
|  | 4 | 2.80 | 20 | 2.8 | 6.0 | 31.6 | 4.3 | 24.2 | 4.9 |
|  | 5 | 2.72 | 20 | 2.7 | 5.3 | 31.3 | 4.3 | 24.8 | 5.0 |
|  | 7 | 2.44 | 18 | 2.8 | 4.9 | 30.6 | 4.5 | 24.5 | 4.4 |
| Y4184U | 0 | 1.97 | 38 | 3.6 | 18.3 | 32.8 | 14.3 | 1.8 | 0.7 |
| (snf1Δ) | 1 | 3.18 | 25 | 1.9 | 14.1 | 32.3 | 8.2 | 15.6 | 3.9 |
| (RHY46) | 2 | 3.42 | 32 | 1.8 | 11.7 | 31.6 | 7.1 | 20.4 | 6.5 |
|  | 3 | 3.60 | 33 | 1.8 | 10.1 | 31.0 | 6.9 | 23.2 | 7.7 |
|  | 4 | 3.88 | 31 | 1.9 | 8.5 | 29.9 | 6.8 | 25.4 | 7.7 |
|  | 5 | 3.78 | 34 | 2.0 | 7.7 | 29.3 | 6.6 | 26.4 | 9.1 |
|  | 7 | 3.48 | 33 | 2.2 | 7.4 | 29.1 | 6.6 | 25.9 | 8.6 |

The results in Table 10 showed that knockout of the chromosomal SNF1 gene in the Y2224 background increased the total lipid content at all time points analyzed, compared to those of the control cultures of ATCC #20362. Most striking, however, was the difference in total lipid production at day 0, which corresponds to the end of 2 days growth in SD media; specifically, the Y2224 (snf1Δ) strain had 170% higher lipid content ["TFAs % DCW"] than the control. The snf1Δ mutant showed oil accumulation even in the presence of a nitrogen source in the SD medium, suggesting that: 1) the regulatory mechanism controlling cellular lipid accumulation was disrupted in this mutant; and 2) the cells were constitutively oleaginous under the given growth condition. Considering the role of the heterotrimeric SNF1 protein kinase in central carbon metabolism in other yeasts, plants, and mammals, it is hypothesized that the SNF1 protein kinase likely functions as the regulatory protein for lipid accumulation.

The results in Table 11 were consistent with those in Table 10, showing that knockout of the chromosomal SNF1 gene in the Y4184U background resulted in significantly higher oil accumulation with respect to the control cultures. Lipid accumulation at day 0, which corresponds to the end of 2 days growth in SD media, was significantly increased in Y4184U (snf1Δ); furthermore, oil content in the snf1Δ mutant was continuously higher throughout the time course. This is in contrast to oil accumulation in the control strain, which peaked on day 3 and then decreased, presumably due to β-oxidation and/or lipase action. The EPA % TFAs was similar between the control and snf1Δ cultures, but the EPA productivity ["EPA % DCW"] was about two-fold higher Y4184U (snf1Δ) as compared to that of the Y4184U (Ura+) control.

Interestingly, the constitutive lipid accumulation of snf1Δ was not observed when strain RHY46 (Y4184U (snf1Δ)) was grown in a complex medium (i.e., FM medium, comprising 6.70 g/L Yeast nitrogen base, 6.00 g $KH_2PO_4$, 2.00 g $K_2HPO_4$, 1.50 g $MgSO_4 \cdot 7H_2O$, 20 g glucose and 5.00 g Yeast extract (BBL); data not shown). After transferring the cells to high glucose media [HGM], however, strain RHY46 had significantly higher lipid content than control strains, as described previously. It appears that there may be another inhibitory component for lipid accumulation, which is active in FM medium independent of Snf1.

EXAMPLE 5

Deletion of Gene Encoding the Snf4 γ-Subunit of the Heterotrimeric SNF1 Protein Kinase in *Yarrowia lipolytica* Increases Total Accumulated Lipid Level The present Example describes identification of the SNF4 gene in *Yarrowia lipolytica*, synthesis of knock-out construct pYRH28 (SEQ ID NO:59), and isolation of *Y. lipolytica* strain Y4184U (snf4Δ). The effect of the chromosomal SNF4 knockout on accumulated lipid level was determined and compared. Specifically, knockout of SNF4 resulted in increased total lipid (measured as percent of the total dry cell weight (TFAs % DCW)) as compared to cells whose native SNF4 had not been knocked out.

Identification Of The *Yarrowia lipolytica* Gene Encoding The Snf4 γ-Subunit Of The Heterotrimeric SNF1 Protein Kinase: In a similar manner to that described for YlSnf1 (Example 1), locus YALI0C03421g (SEQ ID NO:28) within the public *Y. lipolytica* protein database of the "Yeast project Genolevures" was identified as highly similar to sp|P12904 *Saccharomyces cerevisiae* YGL115w SNF4 nuclear regulatory protein. However, annotation indicates the 1116 bp gene is a "*Yarrowia lipolytica* pseudogene" lacking an 'ATG' translation initiation codon.

Further analysis of the upstream sequence surrounding SEQ ID NO:28 identified an 'ATG' translation initiation codon 10 bases upstream. It is hypothesized that the 1126 bp sequence set forth as SEQ ID NO:29 contains an intron at nucleotide bases 25-175, with the translated protein having the sequence set forth as SEQ ID NO:30 and bearing the designation "YlSnf4". SEQ ID NO:30 is expected to encode the Snf4 γ-subunit of the heterotrimeric SNF1 protein kinase and encode a functional protein. BLASTP searches against the BLAST "nr" protein database using the full length amino acid sequence of SEQ ID NO:30 as the query sequence showed that it shared 69% identity and 85% similarity with the *Pichia stipitis* CBS 6054 Snf4 (GenBank Accession No. XP_001383761), with an Expectation value of 4e-129 (best hit). Additionally, SEQ ID NO:30 shared 65% identity and 81% similarity with the *Saccharomyces cerevisiae* Snf4 (GenBank Accession No. M30470; SEQ ID NO:4), with an Expectation value of 6e-116.

Construction Of pYRH28 (SEQ ID NO:59): Plasmid pYRH28 (SEQ ID NO:59), derived from plasmid pYPS161 (Example 2; SEQ ID NO:40), was designed to enable the complete deletion of the SNF4 locus from Y. lipolytica. Specifically, a 2364 bp 5' promoter region (SEQ ID NO:60) of the Yarrowia lipolytica SNF4 gene ("YlSNF4"; SEQ ID NO:29) replaced the AscI/BsiWI fragment of pYPS161 (SEQ ID NO:40; FIG. 5A) and a 1493 bp 3' terminator region (SEQ ID NO:61) of the YlSNF4 gene replaced the PacI/SphI fragment of pYPS161 (SEQ ID NO:40) to produce pYRH28 (SEQ ID NO:59).

Generation Of *Yarrowia lipotytica* Knockout Strain Y4184U (snf41): *Yarrowia lipolytica* strain Y4184U was transformed with the purified 6.5 kB AscI/SphI fragment of snf4 knockout construct pYRH28 (SEQ ID NO:59), according to the General Methods.

To screen for cells having the snf4 deletion, colony PCR was performed using Taq polymerase (Invitrogen; Carlsbad, Calif.), and two different sets of PCR primers. The first set of PCR primers (i.e., SNF4Fii [SEQ ID NO:62] and SNF4Rii [SEQ ID NO:63]) was designed to amplify a 1.0 kB region of the intact YlSNF4 gene, and therefore a snf4 deleted mutant, i.e., snf4Δ, would not produce the band. The second set of primers was designed to produce a band only when the snf4 gene was deleted. Specifically, one primer (i.e., 3UTR-URA3; SEQ ID NO:45) binds to a region in the vector sequences of the introduced 6.5 kB AscI/SphI disruption fragment, and the other primer (i.e., SNF4-conf; SEQ ID NO:64) binds to chromosomal SNF4 terminator sequences outside of the homologous region of the disruption fragment.

The colony PCR was performed as described in Example 2. Of 30 colonies screened, 19 had the SNF4 knockout fragment integrated at a random site in the chromosome and thus were not snf4Δ mutants; however, the cells could grow on Ura-plates, due to the presence of the pYRH28 fragment. Eleven (11) colonies screened contained the snf4 knockout. These *Y. lipolytica* snf4Δ mutants within the Y4184U strain background were designated RHY86 through RHY96.

Evaluation Of *Yarrowia lipotytica* Strains Y4184U (Ura+) And Y4184U (snf4Δ) For Lipid Production: To evaluate the effect of the snf4 knockout on total lipid content and FA composition, *Y. lipolytica* Y4184U (Ura+) control strains Cont-1 and Cont-2 (Example 3) and Y4184U (snf4Δ) strains RHY86 through RHY96 were grown under comparable oleaginous conditions, as described in the General Methods. The only exception to the methodology therein was that 1 mL of the cell cultures were collected by centrifugation after 2 days in SD to enable determination of lipid content and 5 mL of the SD cultures were processed to determine DCW.

The DCW, total lipid content of cells ["TFAs % DCW"] and the concentration of each fatty acid as a weight percent of TFAs ["% TFAs"] for each strain is shown below in Table 12, while averages are highlighted in gray and indicated with "Ave".

TABLE 12

Lipid Composition In *Y. lipolytica* Strains Y4184U (Ura+) And Y4184U (snf4Δ)

| Strain and Growth Condition | Sample | DCW (g/L) | TFAs % DCW | 18:0 Stearic | 18:1 Oleic | 18:2 Linoleic | 20:5 EPA | EPA % DCW |
|---|---|---|---|---|---|---|---|---|
| Y4184U (Ura+): | Cont-1 | 1.74 | 10 | 2.1 | 4.5 | 42.9 | 3.0 | 0.30 |
| 2 Days in SD | Cont-2 | 1.16 | 9 | 1.4 | 3.6 | 48.5 | 3.3 | 0.30 |
|  | AVE | 1.45 | 10 | 1.8 | 4.1 | 45.7 | 3.2 | 0.30 |
| Y4184U (snf4Δ): | RHY86 | 1.36 | 22 | 2.6 | 12.2 | 37.2 | 2.4 | 0.53 |
| 2 Days in SD | RHY87 | 1.30 | 30 | 1.8 | 13.5 | 33.5 | 3.7 | 1.11 |
|  | RHY88 | 2.00 | 36 | 2.1 | 19.8 | 31.8 | 2.2 | 0.79 |
|  | RHY89 | 0.76 | 26 | 0.7 | 9.2 | 33.7 | 6.9 | 1.79 |
|  | RHY90 | 1.50 | 28 | 2.1 | 14.1 | 30.5 | 4.0 | 1.12 |
|  | RHY91 | 1.96 | 26 | 1.8 | 17.9 | 31.6 | 3.0 | 0.78 |
|  | RHY92 | 0.90 | 26 | 0.6 | 7.7 | 34.5 | 4.3 | 1.12 |
|  | RHY93 | 2.52 | 38 | 1.8 | 15.6 | 32.5 | 1.8 | 0.68 |
|  | RHY94 | 2.44 | 38 | 2.8 | 14.5 | 29.5 | 0.9 | 0.34 |
|  | RHY95 | 2.12 | 31 | 2.2 | 17.2 | 30.9 | 2.8 | 0.87 |
|  | RHY96 | 1.94 | 36 | 3.0 | 14.0 | 29.8 | 0.9 | 0.32 |
|  | AVE | 1.71 | 31 | 2.0 | 14.2 | 32.3 | 3.0 | 0.92 |
| Y4184U (Ura+): | Cont-1 | 3.32 | 19 | 2.2 | 6.8 | 32.1 | 26.9 | 5.11 |
| 5 Days in HGM | Cont-2 | 2.96 | 17 | 2.0 | 8.0 | 31.8 | 28.1 | 4.78 |
|  | AVE | 3.14 | 18 | 2.1 | 7.4 | 32.0 | 27.5 | 4.95 |

TABLE 12-continued

| | | | | | | | | |
|---|---|---|---|---|---|---|---|---|
| Y4184U (snf4Δ): | RHY86 | 3.34 | 29 | 2.2 | 10.7 | 29.5 | 25.3 | 7.34 |
| 5 Days in HGM | RHY87 | 3.08 | 26 | 1.8 | 10.7 | 28.7 | 21.2 | 5.51 |
| | RHY88 | 3.64 | 23 | 1.8 | 12.3 | 30.0 | 18.6 | 4.28 |
| | RHY89 | 1.70 | 34 | 1.1 | 9.0 | 27.9 | 28.1 | 9.55 |
| | RHY90 | 2.88 | 25 | 1.3 | 10.1 | 27.5 | 25.5 | 6.38 |
| | RHY91 | 2.78 | 27 | 1.7 | 11.6 | 30.2 | 20.2 | 5.45 |
| | RHY92 | 1.98 | 31 | 1.6 | 8.2 | 30.6 | 24.5 | 7.60 |
| | RHY93 | 4.12 | 26 | 1.0 | 6.9 | 28.1 | 29.2 | 7.59 |
| | RHY94 | 4.20 | 19 | 1.3 | 6.1 | 29.6 | 21.6 | 4.10 |
| | RHY95 | 3.80 | 26 | 1.5 | 11.6 | 28.6 | 23.2 | 6.03 |
| | RHY96 | 3.72 | 19 | 1.6 | 5.4 | 28.6 | 21.7 | 4.12 |
| | AVE | 3.20 | 26 | 1.5 | 9.3 | 29.0 | 23.6 | 6.10 |

The results in Table 12 showed that knockout of the chromosomal snf4 gene in Y4184U (snf4Δ) increased lipid content ["TFAs % DCW"] 3-fold after 2 days culturing in SD media and increased lipid content 44% higher after 5 days incubation in HGM, as compared to that of strain Y4184U (Ura+) whose native Snf4 had not been knocked out. Although average EPA % TFAs was about 14% lower in Y4184U (snf4Δ) than that in Y4184U (Ura+) control strains, average EPA productivity ["EPA % DCW"] was 23% higher in snf4Δ strains, mainly due to the increase in total lipid content.

Those Y4184U (snf4Δ) strains above producing the greatest average EPA % TFAs at the end of 5 days in HGM, which were strains RHY86, RHY89 and RHY93, were grown again in duplicate, as described above, along with cultures of Cont-1 and Cont-2. For direct comparison, the Y4184U (snf1Δ) strains RHY43 and RHY46 (Example 3) were also included. Cultures were analyzed as previously described and results are shown in Table 13.

TABLE 13

Lipid Composition In *Y. lipolytica* Strains Y4184U (Ura+), Y4814U (snf1Δ) And Y4814U (snf4Δ)

| Strain and Growth Condition | Sample | DCW (g/L) | TFA % DCW | % TFA 18:0 | % TFA 18:1 | % TFA 18:2 | % TFA 20:5 | EPA % DCW |
|---|---|---|---|---|---|---|---|---|
| Y4184U (Ura+): | | | 10 | 1.9 | 3.3 | 39.2 | 1.9 | 0.19 |
| 2 Days in SD | Cont1-2 | 1.72 | 11 | 2.0 | 3.3 | 38.9 | 1.9 | 0.21 |
| | Cont2-1 | 1.66 | 10 | 2.2 | 3.2 | 38.6 | 4.2 | 0.43 |
| | Cont2-2 | 1.74 | 11 | 2.3 | 3.2 | 38.4 | 4.2 | 0.45 |
| | AVE | 1.70 | 11 | 2.1 | 3.3 | 38.8 | 3.1 | 0.32 |
| Y4184U (snf1Δ): | RHY43-1 | 2.42 | 33 | 3.9 | 17.3 | 32.9 | 1.6 | 0.53 |
| 2 Days in SD | RHY43-2 | 1.94 | 35 | 3.7 | 16.8 | 33.6 | 1.7 | 0.60 |
| | RHY46-1 | 2.06 | 37 | 3.5 | 16.9 | 33.2 | 1.5 | 0.56 |
| | RHY46-2 | 2.40 | 37 | 3.7 | 17.2 | 32.9 | 1.4 | 0.52 |
| | AVE | 2.21 | 36 | 3.7 | 17.1 | 33.2 | 1.6 | 0.55 |
| Y4184U (snf4Δ): | RHY86-1 | 2.14 | 29 | 3.1 | 19.2 | 32.7 | 2.4 | 0.67 |
| 2 Days in SD | RHY86-2 | 2.50 | 29 | 3.0 | 19.9 | 32.2 | 2.5 | 0.74 |
| | RHY89-1 | 1.70 | 29 | 2.8 | 19.5 | 31.9 | 3.3 | 0.97 |
| | RHY89-2 | 2.00 | 31 | 3.1 | 19.4 | 31.3 | 3.0 | 0.94 |
| | RHY93-1 | 1.64 | 34 | 2.1 | 15.4 | 33.2 | 2.4 | 0.80 |
| | RHY93-2 | 1.96 | 37 | 2.1 | 15.5 | 32.4 | 2.4 | 0.86 |
| | AVE | 1.99 | 32 | 2.7 | 18.2 | 32.3 | 2.7 | 0.83 |
| Y4184U (Ura+): | Cont1-1 | 3.08 | 18 | 1.5 | 6.9 | 30.3 | 27.5 | 4.87 |
| 5 Days in HGM | Cont1-2 | 3.08 | 17 | 1.5 | 6.6 | 30.4 | 27.6 | 4.81 |
| | Cont2-1 | 2.94 | 19 | 2.0 | 7.2 | 30.5 | 29.2 | 5.66 |
| | Cont2-2 | 2.92 | 19 | 2.0 | 7.0 | 30.6 | 29.1 | 5.53 |
| | AVE | 3.01 | 18 | 1.8 | 6.9 | 30.5 | 28.4 | 5.22 |
| Y4184U (snf1Δ): | RHY43-1 | 3.92 | 24 | 2.0 | 10.4 | 29.6 | 23.9 | 5.70 |
| 5 Days in HGM | RHY43-2 | 3.52 | 24 | 2.0 | 10.7 | 29.8 | 23.9 | 5.78 |
| | RHY46-1 | 3.86 | 28 | 1.3 | 7.6 | 29.5 | 27.6 | 7.70 |
| | RHY46-2 | 4.04 | 27 | 1.3 | 8.7 | 29.5 | 27.3 | 7.43 |
| | AVE | 3.84 | 26 | 1.7 | 9.4 | 29.6 | 25.7 | 6.65 |
| Y4184U (snf4Δ): | RHY86-1 | 3.16 | 26 | 3.2 | 15.7 | 28.1 | 18.8 | 4.91 |
| 5 Days in HGM | RHY86-2 | 3.54 | 26 | 3.1 | 15.6 | 28.2 | 18.7 | 4.84 |
| | RHY89-1 | 3.02 | 27 | 2.1 | 13.7 | 29.6 | 19.5 | 5.32 |
| | RHY89-2 | 3.22 | 27 | 2.2 | 13.9 | 29.2 | 19.2 | 5.19 |
| | RHY93-1 | 3.26 | 26 | 1.1 | 7.6 | 28.6 | 28.4 | 7.45 |
| | RHY93-2 | 3.52 | 27 | 1.0 | 8.6 | 28.4 | 28.5 | 7.61 |
| | AVE | 3.29 | 27 | 2.1 | 12.5 | 28.7 | 22.2 | 5.89 |

The results in Table 13 showed that knockout of either the chromosomal YlSNF1 or YlSNF4 gene in Y4184U increased the lipid content ["TFAs % DCW"] approximately three-fold after 2 days culturing in SD media, as compared to that of strain Y4184U (Ura+) whose native SNF1 or SNF4 had not been knocked out. After 5 days incubation in HGM, the total lipid content in both mutants were about 150% of the control.

The total EPA % TFAs for the Y4184U (snf4Δ) strains were comparable to those of controls (i.e., Cont1 and Cont2 strains). Due to the significant increase in total lipid content, the Y4184U (snf1Δ) and Y4184U (snf4Δ) strains exhibited higher EPA productivity ["EPA % DCW"] on average than that of the controls.

EXAMPLE 6

Deletion of Genes Encoding the β-Subunits of the Heterotrimeric SNF1 Protein Kinase in *Yarrowia lipolytica* Increases Total Accumulated Lipid Level The present Example describes identification of two putative β-subunits of the heterotrimeric SNF1 protein kinase in *Yarrowia lipolytica*, synthesis of knock-out constructs pYRH30 (SEQ ID NO:65) and pYRH33 (SEQ ID NO:66), and isolation of *Y. lipolytica* strain Y4184U (gal83Δ) and Y4184U (sip2Δ). The effect of the chromosomal knockouts on accumulated lipid level was determined and compared. Specifically, knockout of Gal83 resulted in increased total lipid (measured as percent of the total dry cell weight ["TFAs % DCW"]) as compared to cells whose native GAL83 had not been knocked out.

Identification Of *Yarrowia lipolytica* Genes Encoding The β-Subunit Of The Heterotrimeric SNF1 Protein Kinase: In a similar manner to that described for YlSnf1 (Example 1), YALI0E13926p (SEQ ID NO:32) and YALI0C00429p (SEQ ID NO:34) within the public *Y. lipolytica* protein database of the "Yeast project Genolevures" were identified as highly similar to the *Saccharomyces cerevisiae* Gal83 β-subunit (GenBank Accession No. X72893; SEQ ID NO:10).

Based on the BLASTP searches, locus YALI0E13926p (SEQ ID NO:32) shared the most similarity with hypothetical protein CAGL0A03696p from *Candida glabrata* CBS138 (GenBank Accession No. XP_444928.1), with 52% identity and 66% similarity, with an expectation value of 2e-66. The next best hit was to the *S. cerevisiae* Gal83 protein of GenBank Accession No. EDN62996.1, with 52% identity, 63% similarity and an expectation value of 2e-65.

Locus YALI0C00429p (SEQ ID NO:34) shared 44% identity and 59% similarity with SEQ ID NO:10, with an expectation value of 4e-47 (best hit).

By homology, *S. cerevisiae* Gal83 is most homologous to YALI0E13926p (SEQ ID NO:32) and *S. cerevisiae* Sip2 is most homologous to YALI0C00429p (SEQ ID NO:34). Based on the above analyses, locus YALI0E13926g (SEQ ID NO:31) was given the designation "YlGAL83" while locus YALI0C00429g (SEQ ID NO:33) was given the designation "YlSIP2".

Construction Of PYRH30 (SEQ ID NO:65) And pYRH33 (SEQ ID NO:66): Plasmids pYRH30 (SEQ ID NO:65) and pYRH33 (SEQ ID NO:66) were both derived from plasmid pYPS161 (SEQ ID NO:40, Example 2) and designed to delete the YlGAL83 and YlSIP2 loci, respectfully, from *Y. lipolytica*. Specifically, a 745 bp 5' promoter region (SEQ ID NO:67) of the YlGAL83 gene (SEQ ID NO:31) replaced the AscI/Bs/WI fragment of pYPS161 (SEQ ID NO:40; FIG. 5A) and a 2030 bp 3' terminator region (SEQ ID NO:68) of the YlGAL83 gene replaced the PacI/SphI fragment of pYPS161 (SEQ ID NO:40) to produce pYRH30 (SEQ ID NO:65).

Similarly, a 2933 bp 5' promoter region (SEQ ID NO:69) of the YlSIP2 gene (SEQ ID NO:33) replaced the AscI/BsiWI fragment of pYPS161 (SEQ ID NO:40; FIG. 5A) and a 1708 bp 3' terminator region (SEQ ID NO:70) of the YlSIP2 gene replaced the PacI/SphI fragment of pYPS161 to produce pYRH33 (SEQ ID NO:66).

Generation Of *Yarrowia lipolytica* Knockout Strain Y4184U (gal83Δ) and Y4184U (sip2Δ): *Yarrowia lipolytica* strain Y4184U was individually transformed with either the purified 5.4 kB AscI/SphI fragment of the YlGAL83 knock-out construct pYRH30 (SEQ ID NO:65) or the 7.3 kB AscI/SphI fragment of the YlSIP2 knockout construct pYRH33 (SEQ ID NO:66).

To screen for cells having the gal83 or sip2 deletion, quantitative real time PCR on YlGAL83 and YlSIP2 was performed, using the *Yarrowia* TEF1 gene as the control (Example 2). Real time PCR primers GAL83-367F (SEQ ID NO:71), GAL83-430R (SEQ ID NO:72), SIP2-827F (SEQ ID NO:73) and SIP2-889R (SEQ ID NO:74), as well as the TaqMan probes GAL83-388T (i.e., 5' 6-FAM™-AAACT-CAACATCACCCATCCCACATC-TAMRA™, wherein the nucleotide sequence is set forth as SEQ ID NO:75) and SIP2-847T (i.e., 5' 6-FAM™-CCTATGGATCGCCAGTCA-GACGG-TAMRA™, wherein the nucleotide sequence is set forth as SEQ ID NO:76), were designed with Primer Express software v 2.0 (AppliedBiosystems, Foster City, Calif.) to target the YlGAL83 and YlSIP2 genes. Primers and probes were obtained from Sigma-Genosys, Woodlands, Tex.

Knockout candidate DNA was prepared by suspending 1 colony in 50 μl of water. Reactions for TEF1, YlSIP2 and YlGAL83 were run separately in triplicate for each sample. The composition of real time PCR reactions was identical to that described in Example 2, with the exception that the forward and reverse primers included GAL83-367F (SEQ ID NO:71), GAL83-430R (SEQ ID NO:72), SIP2-827F (SEQ ID NO:73) and SIP2-889R (SEQ ID NO:74) (supra), as opposed to SNF-734F and SNF-796R (SEQ ID NOs:49 and 50), while the TaqMan probes included GAL83-388T (SEQ ID NO:75) and SIP2-847T (SEQ ID NO:76) (supra), as opposed to SNF-756T (nucleotide sequence set forth as SEQ ID NO:52). Amplification, data collection and data analysis were as described in Example 2.

Of 90 colonies screened, only 2 contained the YlGAL83 knockout within the Y4184U strain background and thus were gal83Δ mutants; these strains were designated RHY114 and RHY115. Similarly, of 90 colonies screened, only 3 contained the YlSIP2 knockout within the Y4184U strain background and thus were sip2Δ mutants; these strains were designated RHY101, RHY102, and RHY109.

The remaining 175 colonies had the GAL83 and SIP2 knockout fragments integated at random sites within the genome and thus were not gal83Δ or sip2Δ mutants.

Evaluation Of *Yarrowia lipolytica* Strains Y4184U (Ura+). Y4184U (gal83Δ) Y4184U (sip2Δ) For Lipid Production; To evaluate and compare the effect of the gal83 and sip2 knock-out on total lipid content and FA composition, *Y. lipolytica* Y4184U (Ura+) control strains Cont-1 and Cont-2 (Example 3), Y4184 (snf1Δ) strain RHY46 (Example 3), Y4184U (gal83Δ) strains RHY114 and RHY115, and Y4184U (sip2Δ) strains RHY101, RHY102, and RHY109 were grown under comparable oleaginous conditions, as described in the General Methods.

The only exception to the methodology therein was that cultures of each strain were grown at a starting $OD_{600}$ of ~0.3 in 25 mL of SD media (versus a starting $OD_{600}$ of ~0.1), 1 mL of the cell cultures were collected by centrifugation after 2 days in SD to enable determination of lipid content and 5 mL of the SD cultures were processed to determine DCW.

The DCW, total lipid content of cells ["TFAs % DCW"] and the concentration of each fatty acid as a weight percent of TFAs ["% TFAs"] for *Y. lipolytica* Y4184U (Ura+) control, Y4184 (snf1Δ), Y4184U (gal83Δ) and Y4184U (sip2Δ) strains is shown below in Table 14, while averages are highlighted in gray and indicated with "Ave".

TABLE 14

Lipid Composition In *Y. lipolytica* Strains Y4184U (Ura+), Y4184 (snf1Δ), Y4184U (gal83Δ) And Y4184U (sip2Δ)

| Strain and Growth Condition | Sample | DCW (g/L) | TFAs % DCW | % TFAs 18:0 Stearic | 18:1 Oleic | 18:2 Linoleic | 20:5 EPA | EPA % DCW |
|---|---|---|---|---|---|---|---|---|
| Y4184U (Ura+): 2 Days in SD | Cont-1 | 1.80 | 9 | 2.1 | 1.2 | 47.0 | 3.7 | 0.33 |
| | Cont-2 | 2.06 | 9 | 2.5 | 1.3 | 45.4 | 3.3 | 0.31 |
| | Ave | 1.93 | 9 | 2.3 | 1.25 | 46.2 | 3.5 | 0.32 |
| Y4184U (snf1Δ): 2 Days in SD | RHY46-1 | 2.12 | 21 | 2.9 | 16.4 | 36.2 | 3.2 | 0.67 |
| | RHY46-2 | 2.04 | 25 | 2.8 | 16.4 | 35.9 | 3.2 | 0.78 |
| | Ave | 2.08 | 23 | 2.9 | 16.4 | 36.1 | 3.2 | 0.73 |
| Y4184U (gal83Δ): 2 Days in SD | RHY114-1 | 3.06 | 19 | 3.7 | 10.1 | 36.1 | 0.2 | 0.04 |
| | RHY114-2 | 3.08 | 19 | 3.8 | 10.2 | 35.9 | 0.2 | 0.03 |
| | RHY115-1 | 2.64 | 17 | 3.1 | 8.8 | 37.4 | 3.9 | 0.67 |
| | RHY115-2 | 2.66 | 18 | 3.2 | 8.9 | 36.9 | 3.8 | 0.70 |
| | Ave | 2.86 | 18 | 3.5 | 9.5 | 36.6 | 2.0 | 0.36 |
| Y4184U (sip2Δ): 2 Days in SD | RHY101-1 | 2.50 | 10 | 2.7 | 1.2 | 39.9 | 3.6 | 0.36 |
| | RHY101-2 | 2.40 | 10 | 2.7 | 1.2 | 40.3 | 3.6 | 0.38 |
| | RHY102-1 | 2.44 | 11 | 2.7 | 1.1 | 39.1 | 4.3 | 0.49 |
| | RHY102-2 | 2.44 | 11 | 2.5 | 1.1 | 40.2 | 4.5 | 0.48 |
| | RHY109-1 | 2.92 | 11 | 2.9 | 1.1 | 38.2 | 4.2 | 0.47 |
| | RHY109-2 | 2.98 | 12 | 3.0 | 1.1 | 37.6 | 4.3 | 0.50 |
| | Ave | 2.61 | 11 | 2.8 | 1.1 | 39.2 | 4.1 | 0.45 |
| Y4184U (Ura+): 5 Days in HGM | Cont-1 | 3.72 | 23 | 2.2 | 8.9 | 31.7 | 26.3 | 6.07 |
| | Cont-2 | 3.96 | 16 | 2.1 | 8.6 | 32.2 | 26.1 | 4.15 |
| | Ave | 3.84 | 20 | 2.2 | 8.8 | 32.0 | 26.2 | 5.11 |
| Y4184U (snf1Δ): 5 Days in HGM | RHY46-1 | 4.56 | 35 | 1.4 | 1.4 | 30.5 | 26.7 | 9.33 |
| | RHY46-2 | 4.62 | 35 | 1.4 | 1.5 | 30.5 | 26.5 | 9.39 |
| | Ave | 4.59 | 35 | 1.4 | 1.5 | 30.5 | 26.6 | 9.36 |
| Y4184U (gal83Δ): 5 Days in HGM | RHY114-1 | 4.80 | 22 | 1.1 | 1.7 | 29.9 | 27.9 | 6.14 |
| | RHY114-2 | 4.90 | 22 | 1.1 | 1.7 | 29.9 | 28.1 | 6.17 |
| | RHY115-1 | 4.30 | 27 | 1.5 | 1.2 | 30.1 | 29.5 | 7.96 |
| | RHY115-2 | 4.58 | 26 | 1.5 | 1.2 | 30.2 | 29.3 | 7.63 |
| | Ave | 4.65 | 24 | 1.3 | 1.5 | 30.0 | 28.7 | 6.98 |

TABLE 14-continued

Lipid Composition In *Y. lipolytica* Strains Y4184U (Ura+), Y4184 (snf1Δ), Y4184U (gal83Δ) And Y4184U (sip2Δ)

| | | | | | | | | |
|---|---|---|---|---|---|---|---|---|
| Y4184U (sip2Δ): 5 Days in HGM | RHY101-1 | 3.90 | 17 | 1.8 | 1.3 | 34.1 | 26.5 | 4.51 |
| | RHY101-2 | 3.84 | 18 | 1.7 | 7.4 | 33.9 | 27.5 | 4.88 |
| | RHY102-1 | 4.02 | 20 | 2.1 | 6.3 | 32.6 | 24.9 | 4.89 |
| | RHY102-2 | 3.84 | 18 | 2.1 | 6.4 | 32.5 | 25.2 | 4.57 |
| | RHY109-1 | 4.70 | 19 | 2.1 | 6.7 | 31.4 | 25.8 | 4.85 |
| | RHY109-2 | 4.82 | 17 | 2.1 | 6.5 | 31.3 | 25.4 | 4.44 |
| | AVE | 4.19 | 18 | 2.0 | 5.8 | 32.6 | 25.9 | 4.69 |

The results in Table 14 showed that knockout of the chromosomal GAL83 gene in Y4184U (gal83Δ) increased lipid content ["TFAs % DCW"] by approximately 2-fold after 2 days culturing in SD media and increased lipid content 20% after 5 days incubation in HGM, as compared to that of strain Y4184U (Ura+) whose native Gal83 had not been knocked out. In addition, the average EPA % TFAs was slightly increased (about 10%) in Y4184U (gal83Δ) than that in Y4184U (Ura+) control strains, resulting in about a 37% increase in EPA productivity ["EPA % DCW"] on average relative to the controls.

In contrast, Y4184U (sip2Δ) did not show a significant effect on lipid accumulation compared to the control. It is possible that the Snf1-Sip2 complex is not involved in lipid accumulation in *Y. lipolytica*. Alternatively, Gal83 could simply be the major β-subunit of the heterotrimeric SNF1 protein kinase complex in this organism. If the latter is true, Sip2 may play a significant role in lipid accumulation under different conditions than that tested in the present Example.

Compared to Y4184U (snf1Δ), Y4184U (gal83Δ) showed less lipid accumulation both in growth and in oleaginous media.

It is noteworthy that duplication of this experiment resulted in almost identical results in terms of the total lipid content and EPA productivity for Y4184U (gal83Δ) and Y4184U (sip2Δ) mutants (data not shown).

EXAMPLE 7

Deletion of Upstream Kinase Genes of the Heterotrimeric SNF1 Protein Kinase in *Yarrowia lipolytica* Increases Total Accumulated Lipid Level The present Example describes identification of two upstream kinases of the heterotrimeric SNF1 protein kinase in *Yarrowia lipolytica*, synthesis of knock-out constructs pYRH31 (SEQ ID NO:77) and pYRH54 (SEQ ID NO:78), and isolation of *Y. lipolytica* strain Y4184U (sak1Δ) and Y4184U (elm1Δ). The effect of the chromosomal knockouts on accumulated lipid level was determined and compared. Knockout of YlSAK1 resulted in increased total lipid (measured as percent of the total dry cell weight ["TFAs % DCW"]) as compared to cells whose native Sak1 had not been knocked out.

Identification Of *Yarrowia lipolytica* Genes Encoding Upstream Kinases Of The Heterotrimeric SNF1 Protein Kinase: In *Saccharomyces cerevisiae*, there are three upstream kinases for SNF1 protein kinase: Sak1, Tos3 and Elm1. These three upstream kinases of Snf1 have a redundant role in phosphorylation and activation of SNF1 protein kinase.

In a similar manner to that described for YlSnf1 (Example 1), YALI0D08822p (SEQ ID NO:36) and YALI0B17556p (SEQ ID NO:38) within the public *Y. lipolytica* protein database of the "Yeast project Genolevures" were identified as putative upstream kinases of SNF1, bearing homology to the *Saccharomyces cerevisiae* Sak1 homologs, Sak1, Tos3 and Elm1. More specifically, based on the BLASTP searches described above, the protein that is encoded by locus YALI0D08822g (SEQ ID NO:36) shared the most similarity was hypothetical protein CAGL0K02167p from *Candida glabrata* CBS138 (GenBank Accession No. XP_448319.1, annotated therein as similar to sp|P38990 *S. cerevisiae* YER129w Serine/threonine-protein kinase, start by similarity), with 55% identity and 67% similarity, with an expectation value of 1 e-86 (fragment #1) and with 32% identity and 53% similarity with an expectation value of 4e-05 (fragment #2). The second best hit was drawn to the ACL053 Cp protein of *Ashbya gossypii* ATCC #10895 (Gen Bank Accession No. NP_983351), annotated therein as a homolog of *S. cerevisiae* YER129W (PAK1) and YGL179C (TOS3). SEQ ID NO:36 and NP_983351 shared 52% identity, 65% similarity and an expectation value of 2e-84 (fragment #1), while fragment #2 of the alignment shared 31% identity and 55% similarity (expectation value of 0.001).

YALI0B17556p (SEQ ID NO:38) shared maximum similarity with the hypothetical protein CIMG_06216 from *Coccidioides immitis* RS (GenBank Accession No. XP_001242320). The proteins shared 44% identity, 60% similarity and an expectation value of 3e-86. The second best hit was drawn to a calcium/calmodulin-dependent protein kinase of *Botryotinia fuckeliana* (GenBank Accession No. ABW82711), sharing 42% identity, 60% similarity and an expectation value of 6e-83.

Since YALI0D08822p (SEQ ID NO:36) showed the highest homology to *S. cerevisiae* Sak1, while YALI0B17556p (SEQ ID NO:38) was homologous to both the *S. cerevisiae* Sak1 and Elm1 proteins, locus YALI0D08822g (SEQ ID NO:35) was given the designation "YlSAK1" while locus YALI0B17556g (SEQ ID NO:37) was given the designation "YlELM1".

Construction Of pYRH31 (SEQ ID NO:77) and pYRH54 (SEQ ID NO:78): Plasmids pYRH31 (SEQ ID NO:77) and pYRH54 (SEQ ID NO:78) were both derived from plasmid pYPS161 (SEQ ID NO:40, Example 2) and designed to delete the YlELM1 and YlSAK1 loci, respectfully. Specifically, a 2542 bp 5' promoter region (SEQ ID NO:79) of the YlELM1 gene (SEQ ID NO:37) replaced the AscI/BsiWI fragment of pYPS161 (SEQ ID NO:40; FIG. 5A) and a 1757 bp 3' terminator region (SEQ ID NO:80) of the YlELM1 gene replaced the PacI/SphI fragment of pYPS161 (SEQ ID NO:40) to produce pYRH31 (SEQ ID NO:77).

Similarly, a 1038 bp 5' promoter region (SEQ ID NO:81) of the YlSAK1 gene (SEQ ID NO:35) replaced the AscI/BsiWI fragment of pYPS161 (SEQ ID NO:40; FIG. 5A) and a 1717 bp 3' terminator region (SEQ ID NO:82) of the YlSAK1 gene replaced the PacI/SphI fragment of pYPS161 to produce pYRH54 (SEQ ID NO:78).

Generation Of *Yarrowia lipolytica* Knockout Strain Y4184U (elm 18Δ) and Y4184U (sak1Δ): *Yarrowia lipolytica* strain Y4184U was transformed with the purified 6.9 kB AscI/SphI fragment of the elm1 knockout construct pYRH31 (SEQ ID NO:77) or with the 5.4 kB AscI/SphI fragment of the sak1 knockout construct pYRH54 (SEQ ID NO:78).

To screen for cells having the elm1 or sak1 deletion, quantitative real time PCR on YlELM1 and YlSAK1 was performed, using the *Yarrowia* TEF1 gene as the control (Example 2). Real time PCR primers ELM1-1406F (SEQ ID NO:83), ELM1-1467R (SEQ ID NO:84), SAK1-210F (SEQ ID NO:85) and SAK1-272R (SEQ ID NO:86), as well as the TaqMan probes ELM1-1431T (i.e., 5' 6-FAM™-AATTGCG-GCCGACAGCGC-TAMRA™, wherein the nucleotide sequence is set forth as SEQ ID NO:87) and SAK1-231T (i.e., 5' 6-FAM™-CATCAAGGTCGTGGATCGCCT-TAMRA™, wherein the nucleotide sequence is set forth as SEQ ID NO:88), were designed with Primer Express software v 2.0 (AppliedBiosystems, Foster City, Calif.) to target the YlELM1 and YlSAK1 genes. Primers and probes were obtained from Sigma-Genosys, Woodlands, Tex.

Knockout candidate DNA was prepared by suspending 1 colony in 50 μl of water. Reactions for TEF1, YlELM1 and YlSAK1 were run separately in triplicate for each sample. The composition of real time PCR reactions was identical to that described in Example 2, with the exception that the forward and reverse primers included ELM1-1406F (SEQ ID NO:83), ELM1-1467R (SEQ ID NO:84), SAK1-210F (SEQ ID NO:85) and SAK1-272R (SEQ ID NO:86) (supra), as opposed to SNF-734F and SNF-796R (SEQ ID NOs:49 and 50), while the TaqMan probes included ELM1-1431T (SEQ ID NO:87) and SAK1-231T (SEQ ID NO:88) (supra), as opposed to SNF-756T (nucleotide sequence set forth as SEQ ID NO:52). Amplification, data collection and data analysis were as described in Example 2.

Of 90 colonies screened, only 2 contained the YlELM1 knockout within the Y4184U strain background and thus were elm1Δ mutants; these strains were designated RHY98 and RHY99. Similarly, of 81 colonies screened, 11 contained the YlSAK1 knockout within the Y4184U strain background and thus were sak1Δ mutants; these strains were designated RHY141 through RHY151.

The remaining 158 colonies had the ELM1 and SAK1 knockout fragments integated at random sites within the genome and thus were not elm1Δ or sak1Δ mutants.

Evaluation Of *Yarrowia lipolytica* Strains Y4184U (Ura+), Y4184U (elm1Δ) And Y4184U (sak1Δ) For Lipid Production: To evaluate and compare the effect of the elm1 and sak1 knockout in *Y. lipolytica* on total lipid content and FA composition, Y4184U (Ura+) control strains Cont-1 and Cont-2 (Example 3), Y4184 (snf1Δ) strain RHY46 (Example 3), Y4184U (elm1Δ) strains RHY98 and RHY99, and Y4184U (sak1Δ) strains RHY141 through RHY151 were grown under comparable oleaginous conditions, as described in the General Methods. The only exception to the methodology therein was that cultures of each strain were grown at a starting $OD_{600}$ of ~0.3 in 25 mL of SD media (versus a starting $OD_{600}$ of ~0.1), 1 mL of the cell cultures were collected by centrifugation after 2 days in SD to enable determination of lipid content and 5 mL of the SD cultures were processed to determine DCW.

The DCW, total lipid content of cells ["TFAs % DCW"] and the concentration of each fatty acid as a weight percent of TFAs ["% TFAs"] for *Y. lipolytica* Y4184U (Ura+) control, Y4184 (snf1Δ), Y4184U (elm1Δ) and Y4184U (sak1Δ) strains is shown below in Table 15, while averages are highlighted in gray and indicated with "Ave".

TABLE 15

Lipid Composition in *Y. lipolytica* Strains Y4184 (Ura+), Y4184 (snf1Δ) And Y4184U (elm1Δ)

| Strain and Growth Condition | Sample | DCW (g/L) | TFAs % DCW | % TFAs | | | | EPA % DCW |
| --- | --- | --- | --- | --- | --- | --- | --- | --- |
| | | | | 18:0 Stearic | 18:1 Oleic | 18:2 Linoleic | 20:5 EPA | |
| Y4184U (Ura+): 2 Days in SD | Cont-1 | 1.80 | 9 | 2.1 | 1.2 | 47.0 | 3.7 | 0.33 |
| | Cont-2 | 2.06 | 9 | 2.5 | 1.3 | 45.4 | 3.3 | 0.31 |
| | AVE | 1.93 | 9 | 2.3 | 1.25 | 46.2 | 3.5 | 0.32 |
| Y4184U (snf1Δ): 2 Days in SD | RHY46-1 | 2.12 | 21 | 2.9 | 16.4 | 36.2 | 3.2 | 0.67 |
| | RHY46-2 | 2.04 | 25 | 2.8 | 16.4 | 35.9 | 3.2 | 0.78 |
| | AVE | 2.08 | 23 | 2.9 | 16.4 | 36.1 | 3.2 | 0.73 |
| Y4184U (elm1Δ): 2 Days in SD | RHY98-1 | 2.42 | 11 | 2.7 | 1.1 | 40.7 | 4.0 | 0.44 |
| | RHY98-2 | 2.42 | 11 | 2.6 | 1.1 | 40.5 | 4.2 | 0.46 |
| | RHY99-1 | 2.66 | 12 | 2.3 | 1.2 | 39.3 | 5.6 | 0.65 |
| | RHY99-2 | 2.64 | 11 | 2.2 | 1.2 | 39.8 | 5.8 | 0.64 |
| | AVE | 2.54 | 11 | 2.5 | 1.15 | 40.1 | 4.9 | 0.55 |

TABLE 15-continued

Lipid Composition in *Y. lipolytica* Strains Y4184 (Ura+), Y4184 (snf1Δ) And Y4184U (elm1Δ)

| Strain | Sample | | | | | | | |
|---|---|---|---|---|---|---|---|---|
| Y4184U (Ura+): 5 Days in HGM | Cont-1 | 3.72 | 23 | 2.2 | 8.9 | 31.7 | 26.3 | 6.07 |
| | Cont-2 | 3.96 | 16 | 2.1 | 8.6 | 32.2 | 26.1 | 4.15 |
| | AVE | 3.84 | 20 | 2.2 | 8.8 | 32.0 | 26.2 | 5.11 |
| Y4184U (snf1Δ): 5 Days in HGM | RHY46-1 | 4.56 | 35 | 1.4 | 1.4 | 30.5 | 26.7 | 9.33 |
| | RHY46-2 | 4.62 | 35 | 1.4 | 1.5 | 30.5 | 26.5 | 9.39 |
| | AVE | 4.59 | 35 | 1.4 | 1.5 | 30.5 | 26.6 | 9.36 |
| Y4184U (elm1Δ): 5 Days in HGM | RHY98-1 | 4.18 | 18 | 2.2 | 1.5 | 32.5 | 25.1 | 4.59 |
| | RHY98-2 | 4.22 | 19 | 2.2 | 1.5 | 32.0 | 25.0 | 4.71 |
| | RHY99-1 | 4.46 | 18 | 2.2 | 1.0 | 31.3 | 28.9 | 5.28 |
| | RHY99-2 | 4.86 | 19 | 2.2 | 1.0 | 31.8 | 28.6 | 5.37 |
| | AVE | 4.43 | 19 | 2.2 | 1.3 | 31.9 | 26.9 | 4.99 |

The results in Table 16 showed that knockout of the chromosomal elm1 gene in Y4184U (elm1Δ) did not show any significant changes in lipid content ["TFAs % DCW"] after 2 days culturing in SD media and after days incubation in HGM, compared to control strains whose native Gal83 had not been knocked out.

TABLE 16

Lipid Composition in *Y. lipolytica* Strains Y4184U (Ura+) And Y4184U (sak1Δ)

| Strain and Growth Condition | Sample | DCW (g/L) | TFAs % DCW | % TFAs | | | | EPA % DCW |
|---|---|---|---|---|---|---|---|---|
| | | | | 18:0 Stearic | 18:1 Oleic | 18:2 Linoleic | 20:5 EPA | |
| Y4184U (Ura+): 2 Days in SD | Cont-1 | 2.52 | 10 | 2.8 | 4.3 | 40.4 | 2.6 | 0.26 |
| | Cont-2 | 2.36 | 10 | 2.7 | 4.3 | 41.7 | 2.6 | 0.25 |
| | AVE | 2.44 | 10 | 2.8 | 4.3 | 41.1 | 2.6 | 0.26 |
| Y4184U (sak1Δ): 2 Days in SD | RHY141 | 2.80 | 23 | 2.1 | 19.4 | 32.1 | 3.5 | 0.80 |
| | RHY142 | 1.52 | 26 | 0.6 | 7.2 | 32.9 | 5.2 | 1.36 |
| | RHY143 | 1.28 | 26 | 0.6 | 7.3 | 34.8 | 5.4 | 1.38 |
| | RHY144 | 1.34 | 28 | 0.6 | 7.2 | 33.4 | 5.1 | 1.40 |
| | RHY146 | 2.34 | 29 | 2.8 | 19.0 | 32.6 | 3.1 | 0.91 |
| | RHY147 | 3.00 | 24 | 2.5 | 19.3 | 31.5 | 2.9 | 0.70 |
| | RHY148 | 2.06 | 31 | 1.4 | 14.0 | 33.8 | 3.4 | 1.05 |
| | RHY149 | 1.50 | 25 | 0.7 | 9.2 | 33.3 | 5.8 | 1.43 |
| | RHY150 | 1.48 | 26 | 0.6 | 7.3 | 34.6 | 5.0 | 1.29 |
| | RHY151 | 1.30 | 26 | 0.7 | 9.4 | 34.2 | 5.4 | 1.41 |
| | AVE | 1.86 | 26 | 1.3 | 11.9 | 33.4 | 4.5 | 1.17 |
| Y4184U (Ura+): 5 Days in HGM | Cont-1 | 4.36 | 22 | 2.3 | 10.5 | 31.0 | 25.3 | 5.49 |
| | Cont-2 | 4.48 | 19 | 2.4 | 10.4 | 31.0 | 25.3 | 4.88 |
| | AVE | 4.42 | 21 | 2.4 | 10.5 | 31.0 | 25.3 | 5.19 |

TABLE 16-continued

Lipid Composition in *Y. lipolytica* Strains Y4184U (Ura+) And Y4184U (sak1Δ)

| | | | | | | | | |
|---|---|---|---|---|---|---|---|---|
| Y4184U (sak1Δ): 5 Days in HGM | RHY141 | 3.82 | 28 | 1.4 | 13.4 | 31.1 | 17.8 | 5.06 |
| | RHY142 | 2.62 | 31 | 0.6 | 7.3 | 29.8 | 25.0 | 7.76 |
| | RHY143 | 2.46 | 28 | 0.7 | 6.6 | 30.8 | 26.1 | 7.39 |
| | RHY144 | 2.40 | 28 | 0.7 | 7.9 | 29.7 | 26.7 | 7.56 |
| | RHY146 | 3.54 | 31 | 1.5 | 12.2 | 29.9 | 21.5 | 6.60 |
| | RHY147 | 4.08 | 25 | 1.4 | 12.0 | 29.6 | 20.4 | 5.15 |
| | RHY148 | 3.90 | 35 | 1.1 | 1.1 | 32.0 | 22.6 | 7.82 |
| | RHY149 | 2.76 | 27 | 0.8 | 0.8 | 28.3 | 28.7 | 7.77 |
| | RHY150 | 2.60 | 26 | 0.7 | 0.7 | 30.8 | 26.7 | 6.97 |
| | RHY151 | 2.70 | 30 | 0.8 | 0.8 | 28.0 | 29.9 | 9.04 |
| | AVE | 3.09 | 29 | 1.0 | 1.0 | 30.0 | 24.9 | 7.11 |

The results in Table 16 showed that knockout of the chromosomal SAK1 gene in Y4184U increased lipid content ["TFAs % DCW"] by 2.6-fold after 2 days culturing in SD media and increased lipid content by approximately 38% after 5 days incubation in HGM, as compared to that of strain Y4184U (Ura+) whose native SAK1 had not been knocked out. In addition, average EPA % TFAs was not significantly different in Y4184U (sak1Δ) compared to that in Y4184U (Ura+) control strains, resulting in about 37% increase in EPA productivity ["EPA % DCW"] on average than that of the controls.

It appears that YlSAK1 is the major upstream kinase for SNF1 complex under the tested condition. However, one cannot exclude the possibility that YlELM1 plays a significant role in lipid accumulation under different conditions. See, for example, the work of Kim, M.-D., et al. (*Eukaryot Cell.*, 4(5):861-866 (2005)), wherein tos3Δ in *Saccharomyces cerevisiae* was found to effect Snf1 catalytic activity only when the cells were grown in glycerol-ethanol, but not during abrupt glucose depletion.

EXAMPLE 8

Overexpression of Gene Encoding the Putative Regulatory Subunit Reg1 of the Heterotrimeric SNF1 Protein Kinase in *Yarrowia lipolytica* Increases Total Accumulated Lipid The present Example describes identification of a putative regulatory subunit of the heterotrimeric SNF1 protein kinase in *Yarrowia lipolytica*, synthesis of overexpression construct pYRH44 (FIG. 8A; SEQ ID NO:89), and isolation of *Y. lipolytica* strain Y4184U+Reg1. The effect of YlREG1 overexpression on accumulated lipid level was determined and compared. YlREG1 overexpression resulted in increased total lipid (measured as percent of the total dry cell weight ["TFAs % DCW"]) as compared to cells whose native Reg1 level had not been manipulated.

Identification Of The *Yarrowia lipolytica* Gene Encoding The Regulatory Subunit Reg1 Of The Heterotrimeric SNF1 Protein Kinase: In *Saccharomyces cerevisiae*, Reg1 is a regulatory subunit for the Glc7 protein phosphatase 1. The Reg1-Glc7 complex regulates Snf1 activity by inactivating Snf1 by dephosphorylation. There is a homolog of Reg1 in *Yarrowia lipolytica*, encoded by locus YALI0B16808g (SEQ ID NO:90).

More specifically, in a similar manner to that described for YlSNF1 (Example 1), locus YALI0B16808p (SEQ ID NO:91) within the public *Y. lipolytica* protein database of the "Yeast project Genolevures" was identified as highly similar to the *Saccharomyces cerevisiae* Reg1 protein (GenBank Accession No. NP_010311; SEQ ID NO:56).

Based on the BLASTP searches, YALI0B16808p (SEQ ID NO:91) shared the most similarity with hypothetical protein DEHA0A01485g from *Debaryomyces hansenii* CBS767 (GenBank Accession No. XP_456386), with 32% identity and 48% similarity, and an expectation value of 4e-51. The next best hit was to the hypothetical protein CaO19.9556 of GenBank Accession No. XP_719582, with 31% identity, 48% similarity and an expectation value of 5e-51. Among proteins with known function, the best hit was the regulatory subunit of type 1 protein phosphatase from *Pichia pastoris* (GenBank Accession No. XP_002489718), with 32% identity and 48% similarity, and an expectation value of 2e-46.

Based on the above analyses, SEQ ID NO:90 is hypothesized to encode the regulatory subunit of the *Y. lipolytica* phosphatase complex and was given the designation "YlREG1".

Construction Of pYRH44 (SEQ ID NO:89): Plasmid pYRH44 (SEQ ID NO:89) was constructed to overexpress the YALI0B16808g (SEQ ID NO:90) gene encoding YlREG1. Plasmid pYRH44 (SEQ ID NO:89) was derived from plasmid pZuFmEaD5s (FIG. 8B; SEQ ID NO:92; described in Example 6 of U.S. Pat. Pub. No. 2008-0274521-A1, hereby incorporated herein by reference). Plasmid pZuFmEaD5s (SEQ ID NO:92) contained a chimeric FBAINm::EaD5S::PEX20 gene, wherein FBAINm is a *Yarrowia lipolytica* promoter (U.S. Pat. No. 7,202,356), EaD5S is a synthetic Δ5 desaturase derived from *Euglena anabaena* and codon-optimized for expression in *Yarrowia*, flanked by NcoI/NotI restriction enzyme sites, and the PEX20 terminator sequence is from the *Yarrowia* PEX20 gene (GenBank Accession No. AF054613).

A 2.2 kB fragment of the YlREG1 gene was amplified by PCR (General Methods) from the *Y. lipolytica* genome using primers REG1-F (SEQ ID NO:93) and REG1-R (SEQ ID NO:94). The amplified gene was digested with PciI/NotI and replaced NcoI/NotI fragment of pZuFmEaD5s (SEQ ID NO:92) to produce pYRH44 (SEQ ID NO:89). Thus, pYRH44 (SEQ ID NO:89) contained a chimeric FBAINm::YlREG1::PEX20 gene.

Generation Of *Yarrowia lipolytica* Strain Y4184U+Reg1: To overexpress YlREG1 in *Yarrowia lipolytica* strain Y4184U, pYRH44 (SEQ ID NO:89) was cut with BsiWI/PacI and a 5.0 kB fragment was isolated and used for transformation (General Methods), thereby producing strain Y4184U+Reg1.

To confirm the overexpression of YlREG1, quantitative real time PCR on YlREG1 was performed, using the *Yarrowia* TEF1 gene as the control (Example 2). Real time PCR primers REG1-1230F (SEQ ID NO:151) and REG1-1296R (SEQ ID NO:152), as well as the TaqMan probe REG1-1254T (i.e., 5' 6-FAM™-CGATCTTCGTCCTCGGCATCT-TAMRA™, wherein the nucleotide sequence is set forth as SEQ ID NO:153) were designed with Primer Express software v 2.0 (AppliedBiosystems, Foster City, Calif.) to target the YlREG1 gene. Primers and probes were obtained from Sigma-Genosys, Woodlands, Tex.

Primers were qualified for real time quantitation using a dilution series of genomic DNA and the PCR conditions detailed below. A linear regression was performed for each primer and probe set and the efficiencies were confirmed to be within 90-110%.

cDNA was prepared by first isolating RNA using Qiagen RNeaSy™ kit (Valencia, Calif.). Residual genomic DNA was then eliminated by treating 2 μg of RNA with Dnase (Catalog No. PN79254, Qiagen) for 15 min at room temperature, followed by inactivation for 5 min at 75° C. The cDNA was generated from 1 μg of treated RNA using the High Capacity cDNA Reverse Transcription Kit from Applied Biosystems (Catalog No. PN 4368813), according to the manufacturer's recommended protocol.

The real time PCR reaction (20 μl) was run on the ABI 7900 using the following reagents: 10 μl ABI TaqMan Universal PCR Master Mix w/o UNG (PN 4326614), 0.2 μl each forward and reverse primers (100 μM), 0.05 μl TaqMan probe (100 μM), 2 μl 1:10 diluted cDNA and 7.55 μl Rnase free water.

Reactions for TEF1 and YlREG1 were run separately in duplicate for each sample. Real time PCR reactions included 0.2 μl each of forward and reverse primers (100 μM) (i.e., ef-324F, ef-392R, REG1-1230F and REG1-1296R, supra), 0.05 μl of each TaqMan probe (100 μM) (i.e., ef-345T and REG1-1254T, supra), 10 μl TaqMan Universal PCR Master Mix—No AmpErase® Uracil-N-Glycosylase (UNG) (Catalog No. PN 4326614, Applied Biosystems), 2 μl diluted cDNA (1:10), and 7.55 μl RNase/DNase free water for a total volume of 20 μl per reaction. Reactions were run on the ABI PRISM® 7900 Sequence Detection System under the following conditions: initial denaturation at 95° C. for 10 min, followed by 40 cycles of denaturation at 95° C. for 15 sec and annealing at 60° C. for 1 min. A negative reverse transcription RNA control of each sample was run with the TEF1 primer set to confirm the absence of genomic DNA.

Real time data was collected automatically during each cycle by monitoring 6-FAM™ fluorescence. Data analysis was performed using TEF1 gene threshold cycle ($C_T$) values for data normalization as per the ABI PRISM® 7900 Sequence Detection System instruction manual (see ABI User Bulletin #2 "Relative Quantitation of Gene Expression").

Based on this analysis, it was concluded that the Y4184U+Reg1 strain showed approximately 2.7-fold higher expression level of the YlREG1 gene, as compared to that of the Y4184U (Ura+) control strain.

Evaluation Of *Yarrowia lipolytica* Strains Y4184U (Ura+) And Y4184U+Reg1; To evaluate and compare the effect of the Reg1 overexpression in *Y. lipolytica* on total lipid content and FA composition, strain Y4184U (Ura+) (control) and strain Y4184U+Reg1 were grown under comparable oleaginous conditions, as described in the General Methods. The only exception to the methodology therein was that cultures of each strain were grown at a starting $OD_{600}$ of ~0.3 in 25 mL of SD media (versus a starting $OD_{600}$ of ~0.1).

The DCW, total lipid content of cells ["TFAs % DCW"] and the concentration of each fatty acid as a weight percent of TFAs ["% TFAs"] for *Y. lipolytica* Y4184U (Ura+) control and Y4184U+Reg1 strains is shown below in Table 17, while averages are highlighted in gray and indicated as "Ave".

TABLE 17

Time Course For Lipid Content And Composition In *Y. lipolytica* Strains Y4184U (Ura+) And Y4184U+Reg1

| Strains | DCW (g/L) | TFAs % DCW | % TFAs | | | | EPA % DCW |
|---|---|---|---|---|---|---|---|
| | | | 18:0 | 18:1 | 18:2 | 20:5 EPA | |
| Y4184U (Ura+) | 5.40 | 16 | 2.0 | 9.9 | 30.7 | 26.6 | 4.21 |
| | 4.64 | 19 | 1.7 | 8.3 | 31.3 | 28.9 | 5.56 |
| Ave | 5.02 | 18 | 1.9 | 9.1 | 31.0 | 27.8 | 4.89 |
| Y4184U +Reg1 | 4.50 | 24 | 2.0 | 11.4 | 29.6 | 26.3 | 6.38 |
| | 2.04 | 34 | 2.0 | 11.2 | 30.5 | 25.4 | 8.56 |
| | 2.50 | 30 | 1.8 | 10.7 | 30.1 | 26.4 | 7.82 |
| | 2.64 | 32 | 2.0 | 11.2 | 30.1 | 25.9 | 8.20 |
| | 1.80 | 29 | 1.9 | 8.8 | 31.5 | 25.0 | 7.24 |
| | 2.40 | 33 | 1.9 | 11.0 | 30.1 | 26.3 | 8.55 |
| | 1.86 | 31 | 2.0 | 10.5 | 30.2 | 25.7 | 7.99 |
| | 2.06 | 29 | 1.9 | 8.5 | 30.6 | 26.3 | 7.71 |
| Ave | 2.48 | 30 | 1.9 | 10.4 | 30.3 | 25.9 | 7.81 |

The results in Table 17 showed that overexpression of YlREG1, corresponding to locus YALI0B16808g, in Y4184U increased lipid content ["TFAs % DCW"] by approximately 67% and increased average EPA productivity ["EPA % DCW"] approximately 60%, as compared to that of strain Y4184U (Ura+).

EXAMPLE 9

Overexpression of Putative Glucose Kinase Proteins of the Heterotrimeric SNF1 Protein Kinase in *Yarrowia lipolytica* Increases Total Accumulated Lipid The present Example describes identification of three putative glucose kinases of the heterotrimeric SNF1 protein kinase in *Yarrowia lipolytica*, synthesis of overexpression constructs pYRH45 (SEQ ID NO:95), pYRH46 (SEQ ID NO:96) and pYRH47 (SEQ ID NO:97) to increase glucose repression signaling, and isolation of *Y. lipolytica* strains Y4184U+Hxk1, Y4184U+Hxk2, and Y4184U+Glk1. The effect of YlHXK1, YlHXK2 and YlGLK1 overexpression on accumulated lipid level was determined and compared. YlHXK2 and YlGLK1 overexpression resulted in increased total lipid (measured as percent of the total dry cell weight ["TFAs % DCW"]) as compared to cells whose native YlHXK2 and YlGLK1 levels had not been manipulated.

Identification Of The *Yarrowia lipolytica* Genes Encoding The Putative Glucose Kinase Proteins Hxk1, Hxk2 And Glk1 Of The Heterotrimeric SNF1 Protein Kinase: In *Saccharomyces cerevisiae*, glucose phosphorylation at position C6 is catalyzed by two hexokinases (i.e., Hxk1, Hxk2) and a glucokinase (i.e., Glk1). Among these, Hxk2 plays an important role in glucose signaling within the cell. The hxk2 deletion derepresses glucose repression, just as reg1 deletion does. In *S. cerevisiae* hxh2 or reg1 mutants, Snf1 becomes active even in the presence of excess glucose (i.e., a repressing condition). If the glucose signaling pathway is conserved between *S. cerevisiae* and *Y. lipolytica*, overexpression of a putative Hxk2 homolog will reduce Snf1 activity, and cells will increase lipid accumulation.

There are three putative homologs of hexokinase/glucokinase in *Yarrowia lipolytica*, encoded by loci YALI0B22308g (SEQ ID NO:98), YALI0E20207g (SEQ ID NO:100) and YALI0E15488g (SEQ ID NO:102).

More specifically, in a similar manner to that described for YlSnf1 (Example 1), locus YALI0B22308p (SEQ ID NO:99), YALI0E20207p (SEQ ID NO:101) and YALI0E15488p (SEQ ID NO:103) within the public *Y. lipolytica* protein database of the "Yeast project Genolevures" were identified as highly similar to the Hxk1 (GenBank Accession No. NP_116711), Hxk2 (GenBank Accession No. NP_011261; SEQ ID NO:57), or Glk1 (GenBank Accession No. NP_009890) proteins of *Saccharomyces cerevisiae*.

Based on the BLASTP searches, YALI0B22308p (SEQ ID NO:99) shared the most similarity with protein HXK_K-LULA from *Kluyveromyces lactis* (GenBank Accession No. XP_453567), with 58% identity and 74% similarity, and an expectation value of 1 e-179. The next best hit was to AFR279Cp of GenBank Accession No. NP_985826, with 56% identity, 72% similarity and an expectation value of 2e-173.

Similarly, YALI0E20207p (SEQ ID NO:101) shared the most similarity with a putative hexokinase from *Penicillium marneffei* ATCC 18224 (GenBank Accession No. XP_002146347), with 33% identity and 49% similarity, and an expectation value of 3e-45. The next best hit was to the hexokinase-1 of GenBank Accession No. XP_001938486, with 31% identity, 50% similarity and an expectation value of 4e-45.

Also, YALI0E15488p (SEQ ID NO:103) shared the most similarity with protein glucokinase GlkA from *Aspergillus fumigatus* Af293 (GenBank Accession No. XP_747854), with 45% identity and 62% similarity, and an expectation value of 2e-111. The next best hit was to the putative glucokinase GlkA protein of GenBank Accession No. XP_001257412, with 45% identity, 61% similarity and an expectation value of 2e-110.

Based on the above analyses, SEQ ID NO:98, SEQ ID NO:100 and SEQ ID NO:102 are hypothesized to encode three different hexokinase/glucokinase homolog isoforms in *Y. lipolytica*. More specifically, locus YALI0B22308g (SEQ ID NO:98) was given the designation "YlHXK1", locus YALI0E20207g (SEQ ID NO:100) was given the designation "YlHXK2" and locus YALI0E15488g (SEQ ID NO:102) was given the designation "YlGLK1".

Construction Of pYRH45 (SEQ ID NO:95), pYRH46 (SEQ ID NO:96) And pYRH47 (SEQ ID NO:97): Plasmids pYRH45 (SEQ ID NO:95) and pYRH46 (SEQ ID NO:96) were constructed to overexpress the YALI0B22308g (SEQ ID NO:98) locus and YALI0E20207g locus (SEQ ID NO:100), respectively, encoding the putative YlHxk1 and YlHxk2. Plasmids pYRH45 (SEQ ID NO:95) and pYRH46 (SEQ ID NO:96) were derived from pZuFmEaD5s (FIG. 8B; SEQ ID NO:92; described in Example 6 of U.S. Pat. Pub. No. 2008-0274521-A1, hereby incorporated herein by reference).

A 2.0 kB fragment of YALI0B22308g (SEQ ID NO:98) was amplified by PCR (General Methods) from the *Y. lipolytica* genome using primers HXK1-F (SEQ ID NO:104) and HXK1-R (SEQ ID NO:105). Similarly, a 1.4 kB fragment of YALI0E20207g (SEQ ID NO:100) was amplified using primers HXK2-F (SEQ ID NO:106) and HXK2-R (SEQ ID NO:107). The amplified genes were digested with PciI/NotI and replaced the NcoI/NotI fragment of pZuFmEaD5s (SEQ ID NO:92) to produce pYRH45 (SEQ ID NO:95) and pYRH46 (SEQ ID NO:96). Thus, pYRH45 (SEQ ID NO:95) contained a chimeric FBAINm::YlHXK1::PEX20 gene while pYRH46 (SEQ ID NO:96) contained a chimeric FBAINm::YlHXK2::PEX20 gene.

To overexpress YlGLK1, a 1.44 kB fragment encoding the ORF was amplified using primers GLK1-F (SEQ ID NO:108) and GLK1-R (SEQ ID NO:109). This was then cut with PciII/NotI and utilized to create plasmid pYRH47 (SEQ ID NO:97, FIG. 9), containing the following components:

TABLE 18

| RE Sites And Nucleotides Within SEQ ID NO: 97 | Description Of Fragment And Chimeric Gene Components |
|---|---|
| PmeI/BsiWI (6187--317) [wherein YlGLK1 can be excised by a PciII/NotI digestion (7143-8582)] | FBAINm::YlGLK1::PEX20, comprising: FBAINm: *Yarrowia lipolytica* FBAINm promoter (U.S. Pat. No. 7,202,356); YlGLK1: *Yarrowia lipolytica* YlGLK1 (SEQ ID NO: 102; locus YALI0E15488g); PEX20: Pex20 terminator sequence from *Yarrowia* PEX20 gene (GenBank Accession No. AF054613) |
| BsiWI/AscI (323-1209) | 887 bp 5' portion of *Yarrowia* Lip7 gene (labeled as "LipY-5'N" in Figure; GenBank Accession No. AJ549519) |
| PacI/SphI (3921/4676) | 756 bp 3' portion of *Yarrowia* Lip7 gene (labeled as "LipY-5'N" in Figure; GenBank Accession No. AJ549519) |
| PacI/PmeI (4685-6172) | *Yarrowia* URA3 gene (GenBank Accession No. AJ306421) |
| 2200-3060 | Ampicillin-resistance gene (Amp$^R$) for selection in *E. coli* |

Generation Of *Yarrowia lipotytica* Strains Y4184U+Hxk1, Y4184U+Hxk2 And Y4184U+Glk1: To overexpress YlHXK1, YlHXK2 and YlGLK1 in *Yarrowia lipolytica* strain Y4184U, the pYRH45 (SEQ ID NO:95), pYRH46 (SEQ ID NO:96) and pYRH47 (SEQ ID NO:97) plasmids were cut with BsiWI/PacI and a 4.9 kB fragment (encompassing the chimeric YlHXK1 gene), a 4.2 kB fragment (encompassing the chimeric YlHXK2 gene) or a 4.2 kB fragment (encompassing the chimeric YlGLK1 gene) was isolated and used for transformation (General Methods), thereby producing strains Y4184U+Hxk1, Y4184U+Hxk2 and Y4184U+Glk1.

To confirm the overexpression of YlHXK1, YlHXK2 and YlGLK1, quantitative real time PCR on YlHXK1, YlHXK2 and YlGLK1 was performed, using the *Yarrowia* TEF1 gene as the control (Example 2). Real time PCR primers HXK1-802F (SEQ ID NO:154), HXK1-863R (SEQ ID NO:155), HXK2-738F (SEQ ID NO:157), HXK2-799R (SEQ ID NO:158), GLK1-105F (SEQ ID NO:160) and GLK1-168R (SEQ ID NO:161), as well as the TaqMan probes HXK1-823T (i.e., 5' 6-FAM™-CCGAGACCCCCATGGCCG-TAMRA™, wherein the nucleotide sequence is set forth as SEQ ID NO:156), HXK2-759T (i.e., 5' 6-FAM™-ATTTC-CAACGCTCCCCTGTGT-TAMRA™, wherein the nucleotide sequence is set forth as SEQ ID NO:159) and GLK1-126T (i.e., 5' 6-FAM™-AGAGCAATGCCCATGATTCCCTC-TAMRA™, wherein the nucleotide sequence is set forth as SEQ ID NO:162) were designed with Primer Express software v 2.0 (AppliedBiosystems, Foster City, Calif.). Primers and probes were obtained from Sigma-Genosys, Woodlands, Tex.

Candidate cDNA was prepared as described in Example 8. Reactions for TEF1, YlHXK1, YlHXK2 and YlGLK1 were run separately in duplicate for each sample. The composition of real time PCR reactions was identical to that described in Example 8, with the exception that the forward and reverse primers included HXK1-802F (SEQ ID NO:154), HXK1-863R (SEQ ID NO:155), HXK2-738F (SEQ ID NO:157), HXK2-799R (SEQ ID NO:158), GLK1-105F (SEQ ID NO:160) and GLK1-168R (SEQ ID NO:161) (supra), as opposed to REG1-1230F and REG1-1296R (SEQ ID NOs: 151 and 152), while the TaqMan probes included HXK1-823T (SEQ ID NO:156), HXK2-759T (SEQ ID NO:159) and GLK1-126T (SEQ ID NO:162) (supra), as opposed to REG1-1254T (nucleotide sequence set forth as SEQ ID NO:153). Amplification, data collection and data analysis were as described in Example 8.

Based on this analysis, it was concluded that the Y4184U+ Hkx1, Y4184U+Hkx2 and Y4184U+Glk1 strains showed approximately 14.7-, 55.5- and 3.2-fold higher expression level of the YlHXK1, YlHXK2 and YlGLK1 genes, respectively, as compared to that of the Y4184U (Ura+) control strain.

Evaluation Of *Yarrowia lipolytica* Strains Y4184U (Ura+). Y4184U+Hxk1. Y4184U+Hxk2 And Y4184U+Glk1: To evaluate the effect of the glucose kinases' overexpression in *Y. lipolytica* on total lipid content and FA composition, strains Y4184U (Ura+) (control), Y4184U+Hxk1, Y4184U+Hxk2 and Y4184U+Glk1 were grown under comparable oleaginous conditions, as described in the General Methods. The only exception to the methodology therein was that cultures of each strain were grown at a starting $OD_{600}$ of ~0.3 in 25 mL of SD media (versus a starting $OD_{600}$ of ~0.1).

The DCW, total lipid content of cells ["TFAs % DCW"] and the concentration of each fatty acid as a weight percent of TFAs ["% TFAs"] for strains *Y. lipolytica* Y4184U (Ura+) control, Y4184U+Hxk1, Y4184U+Hxk2 and Y4184U+Glk1 is shown below in Table 19, Table 20 and Table 21, while averages are highlighted in gray and indicated as "Ave".

TABLE 19

Lipid Content And Composition In *Y. lipolytica* Strains Y4184U (Ura+) And Y4184U+Hkx1

| Strains | DCW (g/L) | TFAs % DCW | % TFAs | | | | EPA % DCW |
|---|---|---|---|---|---|---|---|
| | | | 18:0 | 18:1 | 18:2 | 20:5 EPA | |
| Y4184U (Ura+) | 4.78 | 9 | 2.2 | 8.2 | 31.7 | 26.0 | 2.40 |
| | 3.08 | 19 | 1.9 | 8.7 | 30.6 | 29.0 | 5.65 |
| Ave | 3.93 | 14 | 2.1 | 8.5 | 31.2 | 27.5 | 4.03 |

TABLE 19-continued

Lipid Content And Composition In *Y. lipolytica* Strains Y4184U (Ura+) And Y4184U+Hkx1

| Y4184U +Hxk1 | 3.16 | 15 | 1.7 | 9.4 | 33.5 | 24.6 | 3.79 |
|---|---|---|---|---|---|---|---|
| | 4.68 | 14 | 2.1 | 8.7 | 29.8 | 27.6 | 3.85 |
| | 4.28 | 14 | 2.0 | 9.4 | 30.9 | 27.1 | 3.78 |
| | 4.14 | 14 | 1.9 | 7.9 | 31.1 | 27.8 | 4.02 |
| | 3.36 | 20 | 1.8 | 8.7 | 31.9 | 26.8 | 5.47 |
| | 4.66 | 13 | 1.8 | 8.6 | 32.2 | 26.4 | 3.40 |
| | 4.54 | 14 | 2.0 | 8.2 | 30.7 | 28.2 | 3.91 |
| | 4.28 | 16 | 1.9 | 8.7 | 31.3 | 27.4 | 4.28 |
| | 4.36 | 12 | 1.7 | 7.7 | 31.5 | 27.4 | 3.42 |
| Ave | 4.16 | 15 | 1.9 | 8.6 | 31.4 | 27.0 | 3.99 |

The results in Table 19 showed that overexpression of YlHxk1, corresponding to locus YALI0B22308p, in Y4184U did not result in any significant changes in lipid content ["TFAs % DCW"] or EPA productivity ["EPA % DCW"], when compared to that of strain Y4184U (Ura+) control.

TABLE 20

Lipid Content And Composition In *Y. lipolytica* Strains Y4184U (Ura+) And Y4184U+Hkx2

| Strains | DCW (g/L) | TFAs % DCW | % TFAs | | | | EPA % DCW |
|---|---|---|---|---|---|---|---|
| | | | 18:0 | 18:1 | 18:2 | 20:5 EPA | |
| Y4184U (Ura+) | 4.56 | 17 | 2.1 | 9.9 | 30.5 | 26.5 | 4.47 |
| | 2.18 | 30 | 2.1 | 9.8 | 30.0 | 28.5 | 8.46 |
| Ave | 3.37 | 23 | 2.1 | 9.9 | 30.3 | 27.5 | 6.47 |
| Y4184U +Hxk2 | 3.24 | 26 | 2.6 | 11.3 | 29.7 | 26.1 | 6.67 |
| | 3.14 | 27 | 2.5 | 10.6 | 30.4 | 26.5 | 7.21 |
| | 1.60 | 32 | 2.3 | 9.6 | 30.8 | 23.4 | 7.40 |
| | 2.04 | 31 | 2.3 | 9.8 | 29.4 | 28.4 | 8.83 |
| | 3.20 | 25 | 2.2 | 9.7 | 31.0 | 26.7 | 6.80 |
| | 1.78 | 30 | 2.4 | 10.0 | 29.0 | 28.0 | 8.45 |
| | 1.92 | 29 | 2.2 | 9.5 | 29.7 | 28.5 | 8.25 |
| | 1.64 | 30 | 2.3 | 9.2 | 29.2 | 28.8 | 8.59 |
| Ave | 2.32 | 29 | 2.4 | 10.0 | 29.9 | 27.1 | 7.78 |

The results in Table 20 showed that overexpression of YlHxk2, corresponding to locus YALI0E20207p, in Y4184U increased lipid content ["TFAs % DCW"] by approximately 26% and increased average EPA productivity ["EPA % DCW"] by ~20%, when compared to that of strain Y4184U (Ura+) control.

TABLE 21

Lipid Content And Composition In *Y. lipolytica* Strains Y4184U (Ura+) And Y4184U+Glk1

| Strains | DCW (g/L) | TFAs % DCW | % TFAs |  |  |  | EPA % DCW |
|---|---|---|---|---|---|---|---|
|  |  |  | 18:0 | 18:1 | 18:2 | 20:5 EPA |  |
| Y4184U (Ura+) | 4.34 | 22 | 2.1 | 10.7 | 30.2 | 26.1 | 5.65 |
|  | 3.84 | 21 | 1.7 | 8.6 | 31.5 | 28.4 | 5.93 |
| AVE | 4.09 | 21 | 1.9 | 9.6 | 30.9 | 27.3 | 5.79 |
| Y4184U +Glk1 | 3.14 | 29 | 2.2 | 10.6 | 30.3 | 27.2 | 7.83 |
|  | 3.16 | 25 | 2.0 | 9.2 | 31.1 | 28.1 | 6.96 |
|  | 4.26 | 18 | 2.3 | 8.6 | 28.6 | 30.0 | 5.46 |
|  | 3.82 | 22 | 1.8 | 8.3 | 31.2 | 29.2 | 6.42 |
|  | 2.96 | 25 | 2.0 | 8.7 | 28.9 | 30.1 | 7.62 |
| AVE | 3.47 | 24 | 2.1 | 9.1 | 30.0 | 28.9 | 6.86 |

The results in Table 21 showed that overexpression of YlGlk1, corresponding to locus YALI0E15488p, in Y4184U increased lipid content ["TFAs % DCW"] by approximately 14% and increased average EPA productivity ["EPA % DCW"] by 18%, when compared to that of strain Y4184U (Ura+) control.

EXAMPLE 10

Overexpression of the Regulatory Domain of the Snf1α-Subunit of the Heterotrimeric SNF1 Protein Kinase (or Catalytically Inactive Snf1) in *Yarrowia lipolytia* Increases Total Accumulated Lipid The present Example describes: 1) the synthesis of construct pYRH38 (SEQ ID NO:110), designed for overexpression of the YlSnf1 regulatory domain, and isolation of *Y. lipolytica* strain Y4184U+Snf1 RD; and 2) the synthesis of a mutant variant of construct pYRH40 (SEQ ID NO:112), designed for overexpression of catalytically inactive YlSnf1, and isolation of *Y. lipolytica* strain Y4184U+Snf1 D171A. The effect of overexpression of the YlSnf1 regulatory domain and of catalytically inactive YlSnf1 on accumulated lipid level was determined and compared. In both cases, overexpression resulted in increased total lipid (measured as percent of the total dry cell weight ["TFAs % DCW"]) as compared to cells that had not been similarly manipulated.

Experimental Rationale For Manipulation Of The Snf1 α-Subunit Of The Heterotrimeric SNF1 Protein Kinase: The SNF1 protein kinase complex is heterotrimeric, composed of a catalytic subunit Snf1, a regulatory subunit Snf4, and a targeting (or bridging) β-subunit. Snf1 itself is composed of catalytic and regulatory domains. The Snf1 catalytic domain renders its kinase activity, whereas its regulatory domain interacts with Snf4, the Snf1 catalytic domain, and a β-subunit. In *S. cerevisiae*, the amino-terminal kinase domain corresponds to residues 1-391 of SEQ ID NO:2, while the carboxy-terminal regulatory domain corresponds to residues 392-633 (Jiang & Carlson, *Genes Dev.*, 10(24):3105-3115 (1996)).

In plants, SnRK1 is structurally and functionally analogous to the yeast ortholog, Snf1. It was shown that overexpression of the Snf1 regulatory domain reduced the relief from glucose repression under de-repressing conditions (Lu et al., *The Plant Cell*, 19(8):2484-2499 (2007)). Overexpression of the Snf1 regulatory domain may compete with endogenous Snf1 for the binding of β-subunits of the heterotrimeric SNF1 complex, thereby reducing the native Snf1 activity. Similarly, it is expected that overexpression of catalytically inactive full-length Snf1 will compete with endogenous Snf1 for the β-subunits and Snf4. Alternative to deletion of SNF1 gene, overexpression of a Snf1 protein variant can mimic the effect of snf1 deletion on lipid accumulation in *Yarrowia lipolytica*.

Construction Of pYRH38 (SEQ ID NO:110); Plasmid pYRH38 (SEQ ID NO:110) was constructed for overexpression of the YlSnf1 regulatory domain ["YlSnf1RD"], defined herein as corresponding to the +835 to +1740 region of the YlSNF1 gene. Specifically, a 0.9 kB DNA fragment encoding YlSnf1RD was amplified by PCR (General Methods) from the *Y. lipolytica* genome using primers SNF1 RD-F (SEQ ID N0:111) and SNF1Rii (SEQ ID N0:44). The amplified gene was digested with PciI/NotI and cloned into NcoI/NotI sites of the pYRH47 (SEQ ID N0:97; FIG. 9; described in Example 9, supra) backbone.

Construction Of pYRH40: To construct pYRH40 (SEQ ID NO:112), the wild-type full-length YlSNF1 gene (SEQ ID NO:26) was amplified by PCR (General Methods) from the *Y. lipolytica* genome using primers SNF1 Fii (SEQ ID NO:43) and SNF1 Rii (SEQ ID NO:44). The amplified gene was digested with PciI/NotI and cloned into NcoI/NotI sites of the pYRH47 backbone (FIG. 9; SEQ ID NO:97; described in Example 9, supra).

Generation Of *Yarrowia lipotytica* Strains Y4184U+Snf1RD And Y4184U+Snf1: To overexpress YlSnf1RD in strain Y4184U, pYRH38 (SEQ ID NO:110) was cut with SphI/AscI and a 5.9 kB fragment was isolated and used for transformation (General Methods), thereby producing strain Y4184U+Snf1RD. The pYRH39 plasmid was similarly cut and a 6.7 kB fragment was isolated and transformed, thereby producing strain Y4184U+Snf1.

To confirm the overexpression of YlSnf1RD in strain Y4184U+Snf1RD and YlSNF1 in strain Y4184U+Snf1, quantitative real time PCR was performed, using the *Yarrowia* TEF1 gene as the control (Example 2). Real time PCR primers SNF-734F (SEQ ID NO:49), SNF-796R (SEQ ID NO:50), SNF-1230F (SEQ ID NO:185) and SNF-1293R (SEQ ID NO:186), as well as the TaqMan probes SNF-756T (i.e., 5' 6-FAM™-TGCCGGCGCAAAACACCTG-TAMRA™, wherein the nucleotide sequence is set forth as SEQ ID NO:52) and SNF-1250T (i.e., 5' 6-FAM™-CCCATGGTCCCGCTACCCTG-TAMRA™, wherein the nucleotide sequence is set forth as SEQ ID NO:187) were designed with Primer Express software v 2.0 (AppliedBiosystems, Foster City, Calif.). Primers and probes were obtained from Sigma-Genosys, Woodlands, Tex.

Candidate cDNA was prepared as described in Example 8. Reactions for TEF1, YlSnf1RD and YlSNF1 were run separately in triplicate for each sample. The composition of real time PCR reactions was identical to that described in Example 8, with the exception that the forward and reverse primers included SNF-734F (SEQ ID NO:49), SNF-796R (SEQ ID NO:50), SNF-1230F (SEQ ID NO:185) and SNF-1293R (SEQ ID NO:186) (supra), as opposed to REG1-1230F and REG1-1296R (SEQ ID NOs:151 and 152), while the TaqMan probes included SNF-756T (SEQ ID NO:52) and SNF-1250T (SEQ ID NO:187) (supra), as opposed to REG1-

1254T (nucleotide sequence set forth as SEQ ID NO:153). Amplification, data collection and data analysis were as described in Example 8.

Based on this analysis, it was concluded that the Y4184U+Snf1 and Y4184+Snf1 RD strains showed approximately 3.8- and 4.9-fold higher expression levels of the YlSNF1 and YlSnf1RD genes, respectively, as compared to the native YlSNF1 gene expression level in the Y4184U (Ura+) control strain.

Generation Of *Yarrowia lipotytica* Strains Y4184U+Snf1 D171A: Plasmid pYRH40 (SEQ ID NO:112) was then subjected to site-directed mutagenesis the QuikChange Site-Directed Mutagenesis Kit (Stratagene) and two primers, YlSnf1D171A-F (SEQ ID NO:113) and YlSnf1D171A-R (SEQ ID NO:114). Residue 171 of YlSnf1 (SEQ ID NO:27), encoding an aspartic acid [Asp or D] is a highly conserved residue involved in ATP binding (Hanks, S. K., et al., *Science*, 241 (4861):42-52 (1988)). Thus, substitution of the aspartic acid at residue 171 to alanine [Ala or A] (i.e., a D171A mutation) will result in a catalytically inactive kinase.

To overexpress the catalytically inactive YlSNF1 comprising the D171A mutation in strain Y4184U, the pYRH40 (SEQ ID NO:112) was cut with SphI and AscI and a 6.7 kB fragment was isolated and used for transformation (General Methods), thereby producing strain Y4184U+Snf1 D171A.

Evaluation Of *Yarrowia lipotytica* Strains Y4184U+Snf1 RD And Y4184U+Snf1 D171A: To evaluate and compare the dominant negative effect of the Snf1 variant overexpression in *Y. lipotytica* on total lipid content and FA composition, strain Y4184U (Ura+) (control), the Y4184U (snf1Δ) strain RHY46 (Example 3), strain Y4184U+Snf1 RD and strain Y4184U+Snf1 D171A were grown under comparable oleaginous conditions, as described in the General Methods. The only exception to the methodology therein was that cultures of each strain were grown at a starting $OD_{600}$ of ~0.3 in 25 mL of SD media (versus a starting $OD_{600}$ of ~0.1).

The DCW, total lipid content of cells ["TFAs % DCW"] and the concentration of each fatty acid as a weight percent of TFAs ["% TFAs"] for *Y. lipotytica* strain Y4184U (Ura+), the Y4184U (snf1Δ) strain RHY46, strain Y4184U+Snf1RD and strain Y4184U+Snf1 D171A is shown below in Table 22 and Table 23, while averages are highlighted in gray and indicated with "Ave".

TABLE 22

Lipid Content And Composition In *Y. lipotytica* Strains Y4184U (Ura+), Y4184U (snf1Δ) And Y4184U+Snf1RD

| | | | % TFAs | | | | |
|---|---|---|---|---|---|---|---|
| Strains | DCW (g/L) | TFAs % DCW | 18:0 | 18:1 | 18:2 | 20:5 EPA | EPA % DCW |
| Y4184U (Ura+) | 4.90 | 21 | 2.3 | 8.8 | 32.6 | 24.7 | 5.2 |
| | 4.94 | 20 | 2.3 | 1.1 | 32.7 | 24.7 | 5.0 |
| AVE | 4.92 | 21 | 2.3 | 5.0 | 32.7 | 24.7 | 5.1 |
| Y4184U (snf1Δ) (RHY46) | 6.46 | 35 | 1.4 | 1.2 | 30.4 | 25.9 | 9.1 |
| | 6.16 | 35 | 1.9 | 1.2 | 30.6 | 25.7 | 9.1 |
| AVE | 6.31 | 35 | 1.7 | 1.2 | 30.5 | 25.8 | 9.1 |
| Y4184U+Snf1RD | 5.40 | 23 | 1.7 | 1.5 | 28.8 | 26.6 | 6.2 |
| | 5.50 | 24 | 1.4 | 1.5 | 33.1 | 24.3 | 5.9 |
| | 4.44 | 23 | 1.3 | 1.2 | 32.7 | 26.2 | 6.0 |
| | 4.74 | 22 | 2.4 | 1.2 | 33.6 | 25.2 | 5.5 |
| | 4.52 | 23 | 1.9 | 1.6 | 33.7 | 24.8 | 5.6 |
| | 4.84 | 23 | 1.3 | 1.1 | 33.3 | 26.7 | 6.1 |
| AVE | 4.91 | 23 | 1.7 | 1.4 | 32.5 | 25.6 | 5.9 |

The results in Table 22 showed that overexpression of the YlSNF1 regulatory domain ["YlSnf1RD"] in Y4184U increased lipid content ["TFAs % DCW"] by approximately 10% and increased average EPA productivity ["EPA % DCW"] by 16%, when compared to that of strain Y4184U (Ura+) control.

TABLE 23

Lipid Content And Composition In *Y. lipotytica* Strains Y4184U (Ura+) And Y4184U+Snf1 D171A

| | | | % TFAs | | | | |
|---|---|---|---|---|---|---|---|
| Strains | DCW (g/L) | TFAs % DCW | 18:0 | 18:1 | 18:2 | 20:5 EPA | EPA % DCW |
| Y4184U (Ura+) | 5.94 | 25 | 1.9 | 9.2 | 31.1 | 25.8 | 6.4 |
| | 5.70 | 24 | 1.9 | 9.3 | 31.0 | 26.0 | 6.3 |
| | 6.00 | 24 | 1.9 | 9.1 | 31.3 | 25.7 | 6.0 |
| AVE | 5.88 | 24 | 1.9 | 9.2 | 31.1 | 25.8 | 6.2 |
| Y4184U+ Snf1 D171A | 4.98 | 28 | 1.8 | 7.9 | 30.8 | 29.0 | 8.1 |
| | 4.42 | 27 | 1.8 | 7.8 | 31.3 | 27.6 | 7.4 |
| | 5.28 | 25 | 2.2 | 8.0 | 29.6 | 29.7 | 7.5 |
| | 4.08 | 35 | 1.7 | 8.2 | 32.2 | 27.9 | 9.9 |
| | 4.32 | 24 | 1.8 | 8.5 | 32.6 | 25.7 | 6.3 |
| | 4.46 | 24 | 1.7 | 7.8 | 29.3 | 29.0 | 6.9 |
| | 3.98 | 30 | 2.2 | 10.1 | 31.3 | 25.3 | 7.6 |
| | 4.74 | 26 | 5.2 | 9.5 | 31.3 | 23.5 | 6.1 |
| AVE | 4.53 | 27 | 2.3 | 8.5 | 31.1 | 27.2 | 7.5 |

The results in Table 23 showed that overexpression of a catalytically inactive YlSnf1 mutant ["YlSnf1 D117A"] in Y4184U increased lipid content ["TFAs % DCW"] by approximately 13% and increased average EPA productivity ["EPA % DCW"] by 21%, when compared to that of strain Y4184U (Ura+) control.

EXAMPLE 11

Delineating the SNF1 Protein Kinase Network by Microarray Analysis

The present Example describes use of microarray analysis to gain insight into the genome-wide gene expression profile of strains Y4184U (Ura+) and Y4184U (snf1Δ). Many genes involved in lipid metabolism were found to be up-regulated in Y4184U (snf1Δ) strains, as compared to those of the control strains. Gene ontology analysis clearly indicates that differentially expressed genes in Y4184U (snf1Δ) strains are highly enriched in lipid metabolism related functions. This suggests that *Yarrowia lipolytica* Snf1 is a key regulator for the expression of lipid metabolism genes.

Sample Preparation And Microarray Analysis: The Y4184U (snf1Δ) strains RHY43, RHY46 and RHY47 (Example 3) were chosen as biological replicates. Similarly, strains Y4184U (Ura+) Cont-1, Cont-2, and Cont-3, which had the Snf1 knockout fragment integrated at a random site in the chromosome and thus were not snf1Δ mutants (Example 3), were used as controls.

To prepare RNA samples, cells were grown in SD medium with a starting culture volume of 25 mL and a starting $OD_{600}$ between 0.05 and 0.10. Cells were grown at 30° C. to an $OD_{600}$ of 2.0. A 10 mL aliquot from each culture was harvested by centrifugation in 15 mL conical tubes at about 2,000×g for 2 min. Liquid medium was discarded, and each cell pellet was immediately frozen in liquid nitrogen and stored at −80° C.

Total RNA was prepared from the cell pellets using Triozol™ reagent (Sigma, St. Louis, Mo.). Cell breakage was accomplished using 0.5 mm glass beads and a Mini-Beadbeater 8 (Bartlesville, Okla.) for 3.5 min at top speed, per the manufacturer's instructions. The extracted total RNA was then purified using a Qiagen RNeaSy™ kit.

RNA samples were sent to Roche NimbleGen (Madison, Wis.) for cDNA synthesis and hybridization to a microarray chip based on their proprietary Maskless Array Synthesizer technology. Data acquisition was also performed by Roche NimbleGen.

Data from individual arrays was loaded into Agilent Gene Spring GX 10 (Agilent Technologies, Santa Clara, Calif.). Data was normalized using the quantile normalization method. Student t-test with unequal variance was performed to identify genes whose expression levels changed significantly between the snf1Δ mutant samples and the control samples. Dual criteria consisting of a p-value threshold of equal or less than 0.05, and a 1.5- or 2-fold change cutoff were applied to identify genes whose expression levels were significantly changed in the snf1Δ mutant samples. A p-value cutoff of 0.05 was also applied to create an extended gene set for Gene Ontology ["GO"] enrichment analysis (infra) (Table 24).

Gene Expression Under Control Of The Heterotrimeric SNF1 Protein Kinase: The microarray analysis results showed that the differentially expressed genes in the snf1Δ mutant strains RHY43, RHY46 and RHY47 are significantly enriched in biological processes of fatty acid metabolism and organic acid catabolism, relative to control strains Y4184U (Ura+) Cont-1, Cont-2 and Cont-3 (Table 24).

TABLE 24

Gene Ontology Analysis By Biological Processes For Differentially Expressed Genes In Snf1Δ Mutant Strains

| P-Value | GO Term |
|---|---|
| 4.08E−06 | fatty acid metabolism |
| 0.0002084 | organic acid catabolism |
| 0.0002084 | fatty acid catabolism |
| 0.0002084 | carboxylic acid catabolism |
| 0.001676 | cellular lipid catabolism |
| 0.001676 | lipid catabolism |
| 0.005717 | cellular catabolism |
| 0.006687 | cellular lipid metabolism |
| 0.007202 | cellular macromolecule catabolism |
| 0.008187 | deadenylylation-dependent decapping |
| 0.008779 | lipid metabolism |
| 0.01214 | Catabolism |
| 0.01331 | phosphoinositide phosphorylation |
| 0.01331 | lipid phosphorylation |
| 0.01678 | macromolecule catabolism |

Those genes showing more than a 1.5-fold difference in expression level in snf1Δ strains, as compared to the control strains, are shown in Table 25.

TABLE 25

Genes With Higher Expression In Y4184U snf1Δ Strains Versus Control Y4184U (Ura+) Strains

| Fold Change In snf1Δ vs. Control Strains | | Gene Symbol | Protein Name | Locus Tag Identification No. |
|---|---|---|---|---|
| 301.15 | down | SNF1 | Carbon catabolite derepressing protein kinase | YALI0D02101g |
| 4.34 | down | — | — | YALI0E02024g |
| 2.71 | down | DUR3 | Urea active transporter | YALI0B04202g |
| 2.60 | down | — | Similarity | YALI0A01650g |
| 2.55 | down | FLO5 | Flocculation protein FLO5 precursor | YALI0D00451g |
| 2.40 | down | MEP2 | Ammonium transporter MEP2 | YALI0E27203g |
| 2.40 | down | — | Hypothetical protein | YALI0F22187g |
| 2.15 | down | HSP31 | Probable chaperone HSP31 | YALI0F00682g |
| 2.13 | down | mei2 | Meiosis protein mei2 | YALI0B08272g |
| 2.06 | down | kin(aaB) | AMP-activated protein kinase, beta 2 non-catalytic SU | YALI0F05852g |
| 2.01 | down | — | — | YALI0C07656g |
| 2.01 | down | CTT1 | Catalase T | YALI0E34749g |
| 1.92 | down | — | Mitochondrial protein YNR018W | YALI0F24409g |
| 1.89 | down | — | — | YALI0F03575g |
| 1.85 | down | USO1 | Intracellular protein transport protein USO1 | YALI0D23947g |
| 1.71 | down | SAC7 | GTPase-activating protein SAC7 | YALI0D13684g |
| 1.71 | down | — | Probable oxidoreductase YJR096W | YALI0A19910g |
| 1.71 | down | AREA | Nitrogen regulatory protein areA | YALI0D20482g |

TABLE 25-continued

Genes With Higher Expression In Y4184U snf1Δ Strains Versus Control Y4184U (Ura+) Strains

| Fold Change In snf1Δ vs. Control Strains | | Gene Symbol | Protein Name | Locus Tag Identification No. |
|---|---|---|---|---|
| 1.65 | down | GCY1 | GCY protein | YALI0B07117g |
| 1.64 | down | ALD4 | Potassium-activated aldehyde dehydrogenase, mitochondrial precursor | YALI0E00264g |
| 1.57 | down | UGA4 | GABA-specific permease | YALI0D00495g |
| 1.57 | down | GRX2 | Glutaredoxin-2, mitochondrial precursor | YALI0F30899g |
| 1.53 | down | GCY1 | GCY protein | YALI0A15906g |
| 1.53 | down | KEL1 | Kelch repeat-containing protein 1 | YALI0D21725g |
| 3.07 | up | ALK2 | ALK2 | YALI0F01320g |
| 2.93 | up | — | Hypothetical protein | YALI0E19899g |
| 2.72 | up | PRY1 | Protein PRY1 precursor | YALI0D06149g |
| 2.55 | up | ALK1 | ALK1 | YALI0E25982g |
| 2.32 | up | SPS19 | Peroxisomal 2,4-dienoyl-CoA reductase SPS19 | YALI0F01650g |
| 2.21 | up | dak1 | Dihydroxyacetone kinase 1 | YALI0F01606g |
| 2.06 | up | — | — | YALI0D25960g |
| 1.95 | up | — | — | YALI0E33935g |
| 1.93 | up | B17B1.060 | Related to a retinal short-chain dehydrogenase/reductase | YALI0A19536g |
| 1.93 | up | — | SPBC1683.12 protein | YALI0A09383g |
| 1.92 | up | — | — | YALI0F01628g |
| 1.82 | up | — | — | YALI0E20779g |
| 1.78 | up | SMG1 | SMG1 | YALI0B14014g |
| 1.71 | up | — | — | YALI0A02673g |
| 1.70 | up | — | SPAC869.10c protein | YALI0B09537g |
| 1.68 | up | — | — | YALI0D25971g |
| 1.65 | up | POT1 | 3-ketoacyl-CoA thiolase, peroxisomal precursor | YALI0E18568g |
| 1.65 | up | — | Beta-glucosidase precursor | YALI0F01672g |
| 1.63 | up | CSR1 | Phosphatidylinositol transfer protein CSR1 | YALI0C05511g |
| 1.61 | up | — | Putative triosephosphate isomerase | YALI0F01584g |
| 1.60 | up | — | SPBC947.06c protein | YALI0F08063g |
| 1.59 | up | MUP1 | High-affinity methionine permease | YALI0D16137g |
| 1.59 | up | SCP2 | Fatty acid-binding protein | YALI0E01298g |
| 1.57 | up | IZH1 | Ydr492wp | YALI0E17677g |
| 1.56 | up | catC | Catalase C | YALI0F30987g |
| 1.56 | up | — | — | YALI0B00814g |
| 1.56 | up | MHY1 | C2H2-type zinc finger protein Mhy1p | YALI0B21582g |
| 1.55 | up | URH1 | Uridine nucleosidase | YALI0F12529g |
| 1.54 | up | — | — | YALI0D00154g |
| 1.54 | up | — | Hypothetical 72.2 kDa protein in RPS27A-GPM1 intergenic region | YALI0D16929g |
| 1.54 | up | — | Probable acyl-CoA dehydrogenase | YALI0C16797g |
| 1.54 | up | RME1 | Zinc finger protein RME1 | YALI0E19965g |
| 1.54 | up | — | — | YALI0E06105g |
| 1.53 | up | FRE3 | Ferric reductase transmembrane component 3 precursor | YALI0F07040g |
| 1.52 | up | ADH2 | Alcohol dehydrogenase 2 | YALI0E17787g |
| 1.52 | up | — | SPBC19C2.09 protein | YALI0D15334g |
| 1.51 | up | AAT2 | Aspartate aminotransferase, cytoplasmic | YALI0F29337g |

Since the expression levels of the genes in Table 25 were the most significantly changed in the snf1Δ strains, it is concluded that these genes function under the direct or indirect control of the heterotrimeric SNF1 protein kinase network. Furthermore, since snf1Δ mutants demonstrated a phenotype of increased lipid accumulation (as compared to control strains) [Examples 2-10], other genes displaying increased expression in snf1Δ strains are suitable candidates that could similarly result in increased lipid accumulation when overexpressed. In a comparable manner, those genes displaying decreased expression in snf1Δ strains are suitable candidates for down-regulation or complete gene knockout, which could lead to increased lipid accumulation.

EXAMPLE 12

Overexpression of the Putative Zinc Finger Protein Rme1, Identified Via Microarray Analysis, in *Yarrowia lipolytica* Increases Total Accumulated Lipid A RME1 gene encoding a putative zinc finger protein is up-regulated 1.54-fold in snf1Δ strains, as compared to the control strains (Example 11, Table 25). The present Example describes synthesis of overexpression construct pYRH49 (SEQ ID NO:117), and isolation of *Y. lipolytica* strain Y4184U+Rme1. The effect of YlRME1 overexpression on accumulated lipid level was determined and compared. YlRME1 overexpression resulted in increased total lipid (measured as percent of the total dry cell weight ["TFAs % DCW"]) as compared to cells whose native Rme1 level had not been manipulated.

Experimental Rationale For Manipulation Of The Putative Zinc Finger Protein Rme1; Based on the BLASTP searches, the *Yarrowia* protein encoded by locus YALI0E19965g (SEQ ID NO:115) shared the most homology with the zinc finger protein involved in control of meiosis of *Pichia pastoris* (GenBank Accession No. XP_002490092), sharing 38% identity and 50% similarity, with an expectation value of 1e-16.

The *S. cerevisiae* Rme1 (GenBank Accession No. NP_011558) is a zinc-finger protein that functions as a transcriptional repressor of the meiotic activator IME1 (Covitz, P. A., and Mitchell, A. P., *Genes Dev.*, 7:1598-1608 (1993)). More specifically, YALI0E19965p (SEQ ID NO:116) and GenBank Accession No. NP_011558 share 35% identity and 48% similarity, with an expectation value of 2.0e-12. The homologous regions between these two proteins are mostly around the zinc-finger domains, although it is known that zinc-finger transcription factors are often not very homologous outside of these domains. Locus YALI0E19965p (SEQ ID NO:116) contains three potential zinc-fingers [$Cys_2His_2$], located at amino acid residues 258-282, 291-317 and 324-345 of SEQ ID NO:116, and therefore is considered a putative zinc-finger protein given the designation "YlRme1". It is not certain whether YlRme1 is the functional homolog of the *S. cerevisiae* Rme1, or if YlRme1 just shares sequence homology in its zinc-finger domains.

Since many zinc-finger proteins are transcription factors involved in regulation of gene expression, it is of value to examine the effect of YlRme1 overexpression on total lipid.

Construction Of pYRH49 (SEQ ID NO:117): Plasmid pYRH49 (SEQ ID NO:117) was constructed to overexpress YlRME1 (SEQ ID NO:115). Plasmid pYRH49 (SEQ ID NO:117) was derived from plasmid pZuFmEaD5s (FIG. 8B; SEQ ID NO:92; described in Example 6 of U.S. Pat. Pub. No. 2008-0274521-A1, hereby incorporated herein by reference).

A 1.2 kB fragment of the YlRME1 gene was amplified by PCR (General Methods) from the *Y. lipolytica* genome using primers RME1-F (SEQ ID NO:118) and RME1-R (SEQ ID NO:119). The amplified gene was digested with NcoI/NotI and replaced the NcoI/NotI fragment of pZuFmEaD5s (SEQ ID NO:92) to produce pYRH49 (SEQ ID NO:117). Thus, pYRH49 (SEQ ID NO:117) contained a chimeric FBAINm:: YlRME1::PEX20 gene.

Generation Of *Yarrowia lipotytica* Strain Y4184U+Rme1: To overexpress YlRME1 in Yarrowia lipolytica strain Y4184U, pYRH49 (SEQ ID NO:117) was cut with BsiWI/ PacI/HindIII and a 4.0 kB fragment was isolated and used for transformation (General Methods), thereby producing strain Y4184U+Rme1.

To screen for cells overexpressing YlRME1, quantitative real time PCR on YlRME1 was performed, using the *Yarrowia* TEF1 gene as the control (Example 2). Real time PCR primers RME1-853F (SEQ ID NO:163) and RME1-919R (SEQ ID NO:164), as well as the TaqMan probe RME1-881T (i.e., 5' 6-FAM™-CTGCGTGTGGTCCCTGATCG-TAMRA™, wherein the nucleotide sequence is set forth as SEQ ID NO:165), were designed with Primer Express software v 2.0 (AppliedBiosystems, Foster City, Calif.). Primers and probes were obtained from Sigma-Genosys, Woodlands, Tex.

Candidate cDNA was prepared as described in Example 8. Reactions for TEF1 and YlRME1 were run separately in duplicate for each sample. The composition of real time PCR reactions was identical to that described in Example 8, with the exception that the forward and reverse primers included RME1-853F (SEQ ID NO:163) and RME1-919R (SEQ ID NO:164) (supra), as opposed to REG1-1230F and REG1-1296R (SEQ ID NOs:151 and 152), while the TaqMan probe included RME1-881T (SEQ ID NO:165) (supra), as opposed to REG1-1254T (nucleotide sequence set forth as SEQ ID NO:153). Amplification, data collection and data analysis were as described in Example 8.

Based on this analysis, it was concluded that the Y4184U+ Rme1 strain showed approximately 2.7-fold higher expression level of the YlRME1 gene, as compared to that of the Y4184U (Ura+) control strain.

Evaluation Of *Yarrowia lipotytica* Strains Y4184U (Ura+) And Y4184U+Rme1: To evaluate and compare the effect of the YlRme1 overexpression in *Y. lipolytica* on total lipid content and FA composition, strain Y4184U (Ura+) (control) and strain Y4184U+Rme1 were grown under comparable oleaginous conditions, as described in the General Methods. The only exception to the methodology therein was that cultures of each strain were grown at a starting $OD_{600}$ of ~0.3 in 25 mL of SD media (versus a starting $OD_{600}$ of ~0.1).

The DCW, total lipid content of cells ["TFAs % DCW"] and the concentration of each fatty acid as a weight percent of TFAs ["% TFAs"] for *Y. lipolytica* Y4184U (Ura+) control and Y4184U+Rme1 strains is shown below in Table 26, while averages are highlighted in gray and indicated as "Ave".

TABLE 26

Lipid Content And Composition In *Y. lipolytica* Strains Y4184U (Ura+) And Y4184U+Rme1

| Strains | DCW (g/L) | TFAs % DCW | % TFAs | | | | EPA % DCW |
|---|---|---|---|---|---|---|---|
| | | | 18:0 | 18:1 | 18:2 | 20:5 EPA | |
| Y4184U (Ura+) | 5.02 | 18 | 2.0 | 9.6 | 31.1 | 26.3 | 4.63 |
| | 3.56 | 25 | 1.9 | 9.1 | 30.8 | 28.5 | 7.22 |
| Ave | 4.30 | 21 | 2.0 | 9.3 | 30.9 | 27.4 | 5.92 |
| Y4184U +Rme1 | 2.14 | 30 | 2.1 | 10.2 | 28.9 | 27.8 | 8.39 |
| | 3.66 | 25 | 2.0 | 10.1 | 30.9 | 26.9 | 6.79 |
| | 3.90 | 23 | 2.6 | 10.8 | 27.9 | 26.8 | 6.08 |
| | 3.64 | 24 | 1.9 | 9.0 | 30.3 | 29.0 | 6.86 |
| | 1.98 | 26 | 2.1 | 9.1 | 28.6 | 29.0 | 7.47 |
| | 3.84 | 25 | 2.4 | 11.1 | 30.0 | 25.8 | 6.43 |
| | 2.36 | 25 | 2.4 | 9.3 | 28.4 | 28.5 | 7.18 |
| | 3.68 | 20 | 1.9 | 7.6 | 26.5 | 32.0 | 6.55 |
| | 2.90 | 26 | 2.4 | 10.8 | 28.7 | 26.6 | 6.88 |
| | 2.76 | 29 | 2.6 | 9.0 | 30.8 | 29.3 | 8.42 |
| | 1.46 | 29 | 2.0 | 9.3 | 29.2 | 28.3 | 8.16 |
| Ave | 3.04 | 26 | 2.2 | 9.7 | 29.1 | 28.2 | 7.20 |

The results in Table 26 show that overexpression of the putative zinc finger protein YlRme1, corresponding to locus YALI0E19965p, in Y4184U increased lipid content ["TFAs % DCW"] by approximately 24% and increased average EPA productivity ["EPA % DCW"] approximately 22%, as compared to that of strain Y4184U (Ura+) control.

Based on the positive results demonstrated above, wherein overexpression of YlRME1—which was up-regulated 1.54-fold in snf1Δ strains as compared to control strains—increased lipid accumulation, credence is provided to the hypothesis set forth in Example 11. This hypothesis specifically suggested that the genes set forth in Table 25 demonstrating a higher transcript level in snf1Δ strains, relative to the control strains, could be overexpressed as a means to increase lipid accumulation in the cell. For example, protein Mhy1 (locus YALI0B21582p; SEQ ID NO:121) is another $Cys_2His_2$-type zinc finger that could readily be overexpressed in a manner similar to that described herein for YlRme1, and one would expect to see increased lipid accumulation in the cells (and possibly, increased EPA productivity).

EXAMPLE 13

Overexpression of Asc2 Sks1, Cbr1 and Scs2 Homologs, Identified Via Microarray Analysis, in *Yarrowia lipolytica*

ASC2, SKS1, and CBR1 genes were up-regulated 1.36-, 1.38-, and 1.34-fold, respectively, in snf1Δ strains, as compared to the control strains (Example 11, Table 25). Similarly, the proteins which Scs2 is thought to regulate were up-regulated 2.55- and 3.07-fold, respectively. The present Example describes synthesis of overexpression constructs pYRH41 (SEQ ID NO:122), pYRH42 (SEQ ID NO:123), pYRH48 (SEQ ID NO:124) and pYRH51 (SEQ ID NO:125), and isolation of *Y. lipolytica* strains Y4184U+Asc2, Y4184U+Sks1, Y4184U+Cbr1 and Y4184U+Scs2. The effect of YlAsc2, YlSks1, YlCbr1 and YlScs2 overexpression on accumulated lipid level was determined and compared. None of the overexpressed genes resulted in increased total lipid (measured as percent of the total dry cell weight ["TFAs % DCW"]), when compared to cells whose native YlAsc2, YlSks1, YlCbr1 and YlScs2 levels had not been manipulated.

Experimental Rationale For Manipulation Of Asc2, Sks1, Cbr1 And Scs2: Less than 70 genes were differentially expressed by more than 1.5-fold in snf1Δ strains, when compared to their expression in control strains (Example 11, Table 25). If genes are considered having a fold increase in expression of 1.3 or greater, then the number of genes increases to approximately 200. The present example was performed to assess the value in overexpressing some of these proteins in *Yarrowia lipolytica* strain Y4184U.

As described in Table 25 of Example 11, expression of locus YALI0F05962g (SEQ ID NO:126) was increased 1.36-fold in snf1Δ strains. This ORF, designated herein as YlASC2 (SEQ ID NO:126), encodes an acetyl-CoA synthetase [E.C. 6.2.1.1], which is capable of catalyzing the following reaction: ATP+Acetate+CoA ↔ AMP+pyrophosphate+acetyl-CoA. Although there are two isoforms for acetyl-coA synthetase in *Saccharomyces cerevisiae* (i.e., Acs1 [GenBank Accession No. NP_009347] and Acs2 [GenBank Accession No. NP_013254]), there is a single gene for acetyl-CoA-synthetase in *Y. lipolytica*.

Similarly, expression of locus YALI0B08558g (SEQ ID NO:128) was increased 1.38-fold in snf1Δ strains. This ORF, designated herein as YlSKS1 (SEQ ID NO:128), encodes a putative serine/threonine protein kinase which has homology to SKS1 (Gen Bank Accession No. NP_015299) in *S. cerevisiae*. The *S. cerevisiae* SKS1 is known to be involved in the adaptation to low concentrations of glucose independent of the SNF3 regulated pathway (Yang, Z. and Bisson, L. F., *Yeast*, 12(14):1407-1419 (1996); Vagnoli, P. and Bisson, L. F., *Yeast* 14(4):359-369 (1998)). Of the serine/threonine protein kinases that were up-regulated in snf1Δ strains, the expression of locus YALI0B08558p (SEQ ID NO:129) was most increased.

Finally, expression of locus YALI0D04983g (SEQ ID NO:130) was increased 1.34-fold in snf1Δ strains. This ORF, designated herein as YlCBR1 (SEQ ID NO:130), encodes a microsomal cytochrome $b_5$ reductase [E.C. 1.6.2.2] and is expected to play a role in fatty acid desaturation.

In addition to the ORFs described as SEQ ID NOs:126, 128 and 130, locus YALI0D05291g (SEQ ID NO:132), designated herein as YlSCS2 (SEQ ID NO:132), was also selected for inclusion in the overexpression experiments below. Specifically, ALK1 (locus YALI0E25982g [GenBank Accession No. XM_504406]) and ALK2 (locus YALI0F01320g [GenBank Accession No. XM_504857]) were among the most strongly induced genes in snf1Δ cells (i.e., 2.55-, and 3.07-fold respectively). The transcriptional control system of *Y. lipolytica* ALK1 and ALK2 resembles that of the *S. cerevisiae* INO1 gene (Endoh-Yamagami, S., *Eukaryot. Cell*, 6:734-743 (2007)), and the *S. cerevisiae* SCS2 gene plays an important role in this regulation (Loewen, C. J. R., et al., *Science*, 304(5677):1644-1647 (2004)).

Construction Of Plasmids pYRH41 SEQ ID NO:122), pYRH42 SEQ ID NO:123), pYRH48 SEQ ID NO:124 And pYRH51 SEQ ID NO:125; Plasmid pYRH41, pYRH42, pYRH48, and pYRH51 (SEQ ID NOs:122-125, respectively) were constructed to overexpress YlAsc2 (SEQ ID NO:127), YlScs2 (SEQ ID NO:133), YlCbr1 (SEQ ID NO:131) and YlSks1 (SEQ ID NO:129), respectively. These plasmids were all derived from plasmid pZuFmEaD5s (FIG. 8B; SEQ ID NO:92; described in Example 6 of U.S. Pat. Pub. No. 2008-0274521-A1, hereby incorporated herein by reference).

Specifically, a 2.0 kB fragment of the YlASC2 gene was amplified by PCR (General Methods) from the *Y. lipolytica* genome using primers ASC2-F (SEQ ID NO:134) and ASC2-R (SEQ ID NO:135). A 1.7 kB fragment of the YlSCS2 gene was similarly amplified by PCR from the Y. lipolytica genome using primers SCS2-F (SEQ ID NO:136) and SCS2-R (SEQ ID NO:137). A 0.9 kB fragment of the YlCBR1 gene was amplified by PCR from the *Y. lipolytica* genome using primers CBR1-F (SEQ ID NO:138) and CBR1-R (SEQ ID NO:139). And, a 1.3 kB fragment of the YlSKS1 gene was amplified by PCR from the *Y. lipolytica* genome using primers SKS1-F (SEQ ID NO:140) and SKS1-R (SEQ ID NO:141). Each amplified gene was digested with either PciI/NotI or NcoI/NotI, and then used to replaced the NcoI/NotI fragment of pZuFmEaD5s (SEQ ID NO:92) to produce pYRH41, pYRH42, pYRH48 and pYRH51[[,]] (SEQ ID NOs:122-125, respectively). Thus, each newly constructed plasmid contained a chimeric gene, whose expression was driven by the *Yarrowia* FBAINm promoter.

Generation Of *Yarrowia lipolytica* Strains Y4184U+Asc2. Y4184U+Sks1, Y4184U+Cbr1 and Y4184U+Scs2; To overexpress YlASC2, YlSKS1, YlCBR1 and YlSCS2 in strain Y4184U, each plasmid was digested with BsiWI/PacI (YlASC2, YlSKS1 and YlCBR1) or HindIII/PacI (YlSCS2) and the appropriate fragment was isolated and used for transformation (General Methods), thereby producing strains Y4184U+Asc2, Y4184U+Sks1, Y4184U+Cbr1 and Y4184U+Scs2.

To screen for cells overexpressing YlASC2, YlSKS1, YlCBR1 and YlSCS2, quantitative real time PCR on YlASC2, YlSKS1, YlCBR1 and YlSCS2 was performed, using the *Yarrowia* TEF1 gene as the control (Example 2). Real time PCR primers ACS2-YL-1527F (SEQ ID NO:166), ACS2-YL-1598R (SEQ ID NO:167), SKS1-784F (SEQ ID NO:169), SKS1-846R (SEQ ID NO:170), CBR1-461F (SEQ ID NO:172), CBR1-527R (SEQ ID NO:173), SCS2-310F (SEQ ID NO:175) and SCS2-371R (SEQ ID NO:176), as well as the TaqMan probes ACS2-YL-1548T (i.e., 5' 6-FAM™-CTGGATCCGAGGCCGAGTCGAC-TAMRA™, wherein the nucleotide sequence is set forth as SEQ ID NO:168), SKS1-806T (i.e., 5' 6-FAM™-TGCCG-GCATTCTCAACCGCA-TAMRA™, wherein the nucleotide sequence is set forth as SEQ ID NO:171), CBR1-482T (i.e., 5' 6-FAM™-TGGAGGAACCGGCATCACCCC-TAMRA™, wherein the nucleotide sequence is set forth as SEQ ID NO:174) and SCS2-328T (i.e., 5' 6-FAM™-CCAAGTCCGTGCCCATCACCA-TAMRA™, wherein the nucleotide sequence is set forth as SEQ ID NO:177), were designed with Primer Express software v 2.0 (AppliedBiosystems, Foster City, Calif.). Primers and probes were obtained from Sigma-Genosys, Woodlands, Tex.

Candidate cDNA was prepared as described in Example 8. Reactions for TEF1, YlASC2, YlSKS1, YlCBR1 and YlSCS2 were run separately in duplicate for each sample. The composition of real time PCR reactions was identical to that described in Example 8, with the exception that the forward and reverse primers included ACS2-YL-1527F (SEQ ID NO:166), ACS2-YL-1598R (SEQ ID NO:167), SKS1-784F (SEQ ID NO:169), SKS1-846R (SEQ ID NO:170), CBR1-461F (SEQ ID NO:172), CBR1-527R (SEQ ID NO:173), SCS2-310F (SEQ ID NO:175) and SCS2-371R (SEQ ID NO:176) (supra), as opposed to REG1-1230F and REG1-1296R (SEQ ID NOs:151 and 152), while the TaqMan probes included ACS2-YL-1548T (SEQ ID NO:168), SKS1-806T (SEQ ID NO:171), CBR1-482T (SEQ ID NO:174) and SCS2-328T (SEQ ID NO:177) (supra), as opposed to REG1-1254T (nucleotide sequence set forth as SEQ ID NO:153). Amplification, data collection and data analysis were as described in Example 8.

Based on this analysis, it was concluded that the Y4184U+Asc2, Y4184U+Sks1, Y4184U+Cbr1 and Y4184U+Scs2 strains showed approximately 2.7-, 1.3-, 4.6- and 3.1-fold higher expression levels of the YlASC2, YlSKS1, YlCBR1 and YlSCS2 genes, respectively, as compared to that of the Y4184U (Ura+) control strain.

Evaluation Of *Yarrowia lipolytica* Strains Y4184U (Ura+), Y4184U+Asc2. Y4184U+Sks1, Y4184U+Cbr1 and Y4184U+Scs2: To evaluate and compare the effect of Asc2, Scs2, Cbr1 and Sks1 overexpression in *Y. lipolytica* on total lipid content and FA composition, strain Y4184U (Ura+) (control) and strains Y4184U+Asc2, Y4184U+Sks1, Y4184U+Cbr1 and Y4184U+Scs2 were grown under comparable oleaginous conditions, as described in the General Methods. The only exception to the methodology therein was that cultures of each strain were grown at a starting $OD_{600}$ of ~0.3 in 25 mL of SD media (versus a starting $OD_{600}$ of ~0.1).

The DCW, total lipid content of cells ["TFAs % DCW"] and the concentration of each fatty acid as a weight percent of TFAs ["% TFAs"] for *Y. lipolytica* Y4184U (Ura+) control, Y4184U+Asc2, Y4184U+Sks1, Y4184U+Cbr1 and Y4184U+Scs2 strains is shown below in Table 27, Table 28, Table 29 and Table 30, while averages are highlighted in gray and indicated as "Ave".

TABLE 27

Lipid Content And Composition In *Y. lipolytica* Strains Y4184U (Ura+) And Y4184U+Acs2

| Strains | DCW (g/L) | TFAs % DCW | % TFAs | | | | EPA % DCW |
|---|---|---|---|---|---|---|---|
| | | | 18:0 | 18:1 | 18:2 | 20:5 EPA | |
| Y4184U (Ura+) | 2.42 | 25 | 2.0 | 9.5 | 29.9 | 29.4 | 7.44 |
| | 2.50 | 25 | 1.9 | 9.3 | 29.9 | 29.7 | 7.36 |
| Ave | | | | | | | |
| Y4184U +Asc2 | 3.64 | 15 | 2.0 | 10.4 | 31.9 | 24.2 | 3.70 |
| | 4.24 | 15 | 1.6 | 7.8 | 30.9 | 29.0 | 4.40 |
| | 4.94 | 13 | 2.0 | 7.9 | 30.4 | 28.9 | 3.70 |
| | 3.90 | 17 | 1.6 | 8.4 | 33.1 | 26.0 | 4.40 |
| | 4.64 | 15 | 1.7 | 8.0 | 31.0 | 28.7 | 4.40 |
| | 4.28 | 16 | 1.7 | 8.1 | 31.2 | 28.7 | 4.50 |
| | 4.86 | 13 | 1.7 | 7.6 | 32.5 | 27.2 | 3.60 |
| Ave | | | | | | | |

TABLE 28

Lipid Content And Composition In *Y. lipolytica* Strains Y4184U (Ura+) And Y4184U+Sks1

| Strains | DCW (g/L) | TFAs % DCW | % TFAs | | | | EPA % DCW |
|---|---|---|---|---|---|---|---|
| | | | 18:0 | 18:1 | 18:2 | 20:5 EPA | |
| Y4184U (Ura+) | 4.50 | 20 | 2.2 | 11.2 | 30.0 | 25.9 | 5.18 |
| | 3.38 | 28 | 1.9 | 9.8 | 30.4 | 28.4 | 7.84 |
| Ave | | | | | | | |
| Y4184U +Sks1 | 4.26 | 18 | 2.2 | 9.5 | 29.7 | 28.4 | 5.10 |
| | 4.32 | 20 | 2.4 | 11.2 | 29.8 | 26.4 | 5.23 |
| | 4.92 | 16 | 1.8 | 8.3 | 31.2 | 28.4 | 4.61 |
| | 4.76 | 19 | 2.2 | 10.6 | 30.0 | 26.2 | 4.97 |
| | 4.62 | 15 | 2.1 | 9.8 | 29.8 | 27.0 | 3.93 |
| | 4.84 | 19 | 2.0 | 8.7 | 30.7 | 28.5 | 5.28 |
| | 3.90 | 22 | 1.9 | 8.4 | 30.7 | 29.3 | 6.38 |
| | 3.36 | 23 | 1.9 | 8.8 | 30.2 | 28.5 | 6.43 |
| Ave | | | | | | | |

TABLE 29

Lipid Content And Composition In *Y. lipolytica* Strains Y4184U (Ura+) And Y4184U+Cbr1

| Strains | DCW (g/L) | TFAs % DCW | % TFAs |  |  |  | EPA % DCW |
|---|---|---|---|---|---|---|---|
|  |  |  | 18:0 | 18:1 | 18:2 | 20:5 EPA |  |
| Y4184U (Ura+) | 4.84 | 15 | 1.8 | 9.4 | 31.7 | 25.9 | 3.89 |
|  | 4.30 | 16 | 1.7 | 8.0 | 32.5 | 27.2 | 4.46 |
| AVE | 4.57 | 16 | 1.8 | 8.7 | 32.1 | 26.6 | 4.18 |
| Y4184U +Cbr1 | 3.50 | 18 | 1.8 | 7.8 | 32.1 | 23.7 | 4.39 |
|  | 4.80 | 17 | 1.8 | 8.1 | 31.6 | 27.9 | 4.81 |
|  | 4.56 | 13 | 2.0 | 8.9 | 30.6 | 26.4 | 3.38 |
|  | 3.64 | 19 | 1.9 | 8.4 | 31.1 | 27.6 | 5.12 |
|  | 3.30 | 20 | 2.2 | 6.9 | 31.5 | 25.7 | 5.04 |
|  | 4.52 | 16 | 2.1 | 8.6 | 30.2 | 28.4 | 4.50 |
|  | 3.30 | 23 | 2.0 | 9.4 | 30.9 | 26.7 | 6.03 |
|  | 3.52 | 18 | 1.8 | 8.3 | 32.0 | 27.2 | 4.94 |
|  | 3.00 | 19 | 2.1 | 7.9 | 32.0 | 25.8 | 4.95 |
| AVE | 3.68 | 18 | 2.0 | 8.3 | 31.3 | 26.6 | 4.80 |

TABLE 30

Lipid Content And Composition In *Y. lipolytica* Strains Y4184U (Ura+) And Y4184U+Scs2

| Strains | DCW (g/L) | TFAs % DCW | % TFAs |  |  |  | EPA % DCW |
|---|---|---|---|---|---|---|---|
|  |  |  | 18:0 | 18:1 | 18:2 | 20:5 EPA |  |
| Y4184U (Ura+) | 4.24 | 23 | 2.2 | 11.0 | 30.5 | 25.7 | 5.84 |
|  | 3.54 | 26 | 1.9 | 9.6 | 31.0 | 27.9 | 7.13 |
| AVE | 3.89 | 24 | 2.1 | 10.3 | 30.7 | 26.8 | 6.49 |
| Y4184U +Scs2 | 4.02 | 18 | 2.4 | 9.9 | 31.0 | 26.6 | 4.83 |
|  | 3.30 | 22 | 2.0 | 9.6 | 30.9 | 27.7 | 6.09 |
|  | 3.60 | 20 | 2.2 | 8.7 | 32.5 | 25.6 | 5.09 |
|  | 3.64 | 22 | 2.2 | 10.0 | 31.1 | 26.8 | 6.02 |
|  | 3.32 | 23 | 2.0 | 9.1 | 31.1 | 27.8 | 6.41 |
|  | 3.64 | 26 | 2.4 | 12.1 | 30.8 | 23.1 | 5.90 |
|  | 3.50 | 19 | 2.5 | 10.4 | 29.9 | 26.8 | 5.14 |
| AVE | 3.57 | 21 | 2.2 | 10.0 | 31.0 | 26.3 | 5.64 |

The results in Tables 27, 28 and 30 showed that overexpression of YlAsc2 (corresponding to locus YALI0F05962g), YlSks1 (corresponding to locus YALI0B08558p) and YlScs2 (corresponding to locus YALI0D05291g) in Y4184U did not result in increased lipid content ["TFAs % DCW"], as compared to that of strain Y4184U (Ura+) control.

In contrast, overexpression of YlCbr1, corresponding to locus YALI0D04983g, in Y4184U increased lipid content ["TFAs % DCW"] by approximately 13% and increased average EPA productivity ["EPA % DCW"] approximately 15%, as compared to that of strain Y4184U (Ura+) control.

EXAMPLE 14

Overexpression of Glucose Transporter Snf3, Identified Via Microarray Analysis, in *Yarrowia lipolytica* Increases Total Accumulated Lipid Level A SNF3 gene encoding a putative glucose transporter is up-regulated 1.3-fold in snf1Δ strains, as compared to the control strains (Example 11, Table 25). The present Example describes synthesis of overexpression construct pYRH50 (SEQ ID NO:142), and isolation of *Y. lipolytica* strain Y4184U+Snf3. The effect of YlSnf3 overexpression on accumulated lipid level was determined and compared. YlSNF3 overexpression resulted in increased total lipid (measured as percent of the total dry cell weight ["TFAs % DCW"]) as compared to cells whose native Snf3 level had not been manipulated.

Experimental Rationale For Manipulation Of The Glucose Transporter Snf3: As described in Table 25 of Example 11, expression of locus YALI0C06424g (SEQ ID NO:143) was increased 1.3-fold in snf1Δ strains. Based on the BLASTP searches, the *Yarrowia* protein encoded by locus YALI0C06424g shared the most homology with the Snf3 protein (Gen Bank Accession No. NP_010087) in *Saccharomyces cerevisiae* (i.e., the proteins share 46% identity and 67% similarity, with an expectation value of 5e-130). The YALI0C06424g ORF was therefore designated herein as YlSNF3.

The *S. cerevisiae* Snf3 [ScSnf3] is a plasma membrane protein that functions as a glucose sensor (Özcan, S., et al., *EMBO J.*, 17:2566-2573 (1998)), although the protein lacks the ability to transport glucose (despite significant homology to glucose transporters). ScSnf3, unlike other glucose transporters, contains a long C-terminal tail comprising 341 amino acids in the cytoplasm that plays an important role in glucose sensing (Özcan, S., et al., supra).

Although It is clear that YlSnf3 does not have a C-terminal tail that corresponds to that of ScSnf3, it is possible that YlSnf3 encodes a glucose transporter. Thus, the effect of YlSnf3 overexpression on total lipid was examined below.

Construction Of pYRH50 (SEQ ID NO:142): Plasmid pYRH50 (SEQ ID NO:142) was constructed to overexpress YlSnf3 (SEQ ID NO:144). Plasmid pYRH50 (SEQ ID NO:142) was derived from plasmid pZuFmEaD5s (FIG. 8B; SEQ ID NO:92; described in Example 6 of U.S. Pat. Pub. No. 2008-0274521-A1, hereby incorporated herein by reference).

A 1.55 kB fragment of comprising the YlSNF3 gene was amplified by PCR (General Methods) from the *Y. lipolytica* genome using primers SNF3-F (SEQ ID NO:145) and SNF3-R (SEQ ID NO:146). The amplified gene was digested with NcoI/NotI and replaced NcoI/NotI fragment of pZuFmEaD5s (SEQ ID NO:92) to produce pYRH50 (SEQ ID NO:142). Thus, pYRH50 (SEQ ID NO:142) contained a chimeric FBAINm::YlSNF3::PEX20 gene.

Generation Of *Yarrowia lipolytica* Strain Y4184U+Snf3: To overexpress YlSNF3 in strain Y4184U, pYRH50 (SEQ ID NO:142) was cut with restriction enzymes and a 4.3 kB BsiWI/PacI fragment was isolated and used for transformation (General Methods), thereby producing strain Y4184U+Snf3.

To screen for cells overexpressing YlSNF3, quantitative real time PCR on YlRME1 was performed, using the *Yarrowia* TEF1 gene as the control (Example 2). Real time PCR primers SNF3-999F (SEQ ID NO:178) and SNF3-1066R (SEQ ID NO:179), as well as the TaqMan probe SNF3-1020T (i.e., 5' 6-FAM™-ATCGGAGCTATCGTCATGTGCTC-TAMRA™, wherein the nucleotide sequence is set forth as SEQ ID NO:180), were designed with Primer Express software v 2.0 (AppliedBiosystems, Foster City, Calif.). Primers and probe were obtained from Sigma-Genosys, Woodlands, Tex.

Candidate cDNA was prepared as described in Example 8. Reactions for TEF1 and YlSNF3 were run separately in duplicate for each sample. The composition of real time PCR reactions was identical to that described in Example 8, with the exception that the forward and reverse primers included SNF3-999F (SEQ ID NO:178) and SNF3-1066R (SEQ ID NO:179) (supra), as opposed to REG1-1230F and REG1-1296R (SEQ ID NOs:151 and 152), while the TaqMan probe included SNF3-1020T (SEQ ID NO:180) (supra), as opposed to REG1-1254T (nucleotide sequence set forth as SEQ ID NO:153). Amplification, data collection and data analysis were as described in Example 8.

Based on this analysis, it was concluded that the Y4184U+Snf3 strain showed approximately 2.2-fold higher expression level of the YlSNF3 gene, as compared to that of the Y4184U (Ura+) control strain.

Evaluation Of *Yarrowia lipolytica* Strains Y4184U (Ura+) And Y4184U+Snf3: To evaluate and compare the effect of the Snf3 overexpression in *Y. lipolytica* on total lipid content and FA composition, strain Y4184U (Ura+) (control) and strain Y4184U+Snf3 were grown under comparable oleaginous conditions, as described in the General Methods. The only exception to the methodology therein was that cultures of each strain were grown at a starting $OD_{600}$ of ~0.3 in 25 mL of SD media (versus a starting $OD_{600}$ of ~0.1).

The DCW, total lipid content of cells ["TFAs % DCW"] and the concentration of each fatty acid as a weight percent of TFAs ["% TFAs"] for *Y. lipolytica* Y4184U (Ura+) control and Y4184U+Snf3 strains is shown below in Table 31, while averages are highlighted in gray and indicated as "Ave".

TABLE 31

Lipid Content And Composition in *Y. lipolytica* Strains Y4184U (Ura+) And Y4184U+Snf3

| Strains | DCW (g/L) | FAME (% DCW) | % TFAs | | | | |
|---|---|---|---|---|---|---|---|
| | | | 18:0 | 18:1 | 18:2 | 20:5 EPA | EPA % DCW |
| Y4184U (Ura+) | 4.44 | 21 | 2.3 | 11.5 | 29.6 | 25.8 | 5.42 |
| | 3.26 | 23 | 2.0 | 9.9 | 30.2 | 28.6 | 6.66 |
| AVE | | | | | | | |
| Y4184U +Snf3 | 2.70 | 30 | 2.6 | 12.0 | 29.2 | 26.0 | 7.72 |
| | 1.88 | 28 | 2.1 | 10.1 | 30.4 | 27.2 | 7.74 |
| | 3.44 | 29 | 2.5 | 11.8 | 29.1 | 25.7 | 7.38 |
| | 2.46 | 28 | 1.9 | 8.6 | 30.7 | 29.0 | 8.22 |
| | 2.96 | 25 | 2.6 | 10.0 | 28.7 | 28.9 | 7.33 |
| | 3.50 | 22 | 2.0 | 8.7 | 29.5 | 29.3 | 6.53 |
| | 3.64 | 25 | 2.0 | 12.5 | 31.1 | 23.1 | 5.84 |
| | 3.92 | 23 | 2.2 | 9.3 | 29.3 | 28.9 | 6.57 |
| AVE | | | | | | | |

The results in Table 31 show that overexpression of the putative glucose transporter YlSnf3, corresponding to locus YALI0C06424g, in Y4184U increased lipid content ["TFAs % DCW"] by approximately 14% and increased average EPA productivity ["EPA % DCW"] approximately 14%, as compared to that of strain Y4184U (Ura+) control.

Based on the positive results demonstrated above, wherein overexpression of the putative glucose transporter YlSnf3 increased lipid production relative to the control strains, it is hypothesized that overexpression of other glucose transporters should produce a similar result. For example, glucose transporters YALI0C08943p (GenBank Accession No. XP_501621) and YALI0F19184p (GenBank Accession No. XP_505610) could readily be overexpressed in a manner similar to that described herein for YlSnf3, and one would expect to see increased lipid accumulation in the cells (and possibly, increased EPA productivity). Similarly, a heterologous glucose transporter could be overexpressed, such as the HXT proteins from *S. cerevisiae* (e.g., Hxt1, GenBank Accession No. NP_011962; Hxt3, GenBank Accession No. NP_010632; Hxt4, GenBank Accession No. NP_011960).

EXAMPLE 15

Manipulation of Acetyl-CoA Carboxylase Phosphorylation Sites in *Yarrowia lipolytica* Increases Total Accumulated Lipid The present Example describes the identification of the heterotrimeric SNF1 protein kinase phosphorylation site(s) within acetyl-CoA carboxylase ["ACC"], mutation of this site(s) to produce a mutant ACC protein that can not be phosphorylated, synthesis of a vector suitable to overexpress the mutant ACC* protein, and isolation of *Y. lipolytica* strain Y4184U+ACC*. The effect of YlACC* overexpression on accumulated lipid level will be determined and compared. YlACC* overexpression is expected to result in increased total lipid (measured as percent of the total dry cell weight ["TFAs % DCW"]) as compared to cells whose native ACC had not been mutated.

Experimental Rationale For Manipulation Of Acetyl-CoA Carboxylase: Acetyl-CoA carboxylase ["ACC"; EC 6.4.1.2] catalyzes the key regulated step in fatty acid synthesis. In mammals, the enzyme activity of ACC is regulated by AMP-activated protein kinase ["AMPK"], i.e., the mammalian ortholog of Snf1 in mammals. AMPK appears to upregulate the expression of ACC by dephosphorylating specific ACC residues; for example, it was shown that serine residue 79 ["Ser-79"] of rat ACC (GenBank Accession No. NP_071529; SEQ ID NO:147) is entirely responsible for the inactivation of ACC by AMPK (Davies, S. P. et al., *Eur. J. Biochem.*, 187:183-190 (1990); Ha, J., et al., *J. Biol. Chem.*, 269(35):22162-22168 (1994)). In other words, ACC activity may be inhibited by AMPK/SNF1 by phosphorylation.

In *Saccharomyces cerevisiae*, it has also been demonstrated that enzymatic activity of ACC is regulated by the heterotrimeric SNF1 protein kinase by phosphorylation (Mitchelhill, K. I., et al., *J. Biol. Chem.*, 269:2361-2364 (1994); Woods, A., et al., *J. Biol. Chem.*, 269:19509-19515 (1994)); however, the corresponding Ser-79 site of the rat ACC is not present in the yeast ACC. It is therefore expected that regulation of *S. cerevisiae*'s ACC by SNF1 must therefore occur by phosphorylation at a different site on the protein.

The consensus phosphorylation site for the AMPK/Snf1 protein kinase family has been suggested to be Hyd-(Xaa-Bas)-Xaa-Xaa-Ser/Thr-Xaa-Xaa-Xaa-Hyd (SEQ ID NO:148), where Hyd is a bulky hydrophobic side chain (i.e., Leu, Met, Ile, Phe, or Val), Bas is a basic residue (i.e., Arg, Lys or His, wherein Arg is more basic than Lys, which is more basic than His), and Xaa is any amino acid residue (reviewed in Hardie, D. G., et al., *Annu. Rev. Biochem.*, 67:821-855 (1998)).

*Yarrowia lipolytica* locus YALI0C11407g (SEQ ID NO:149) encodes ACC. An alignment of the ACC proteins from mouse (GenBank Accession No. NP_579938), rat (GenBank Accession No. NP_071529), bovine (GenBank Accession No. NP_071529), *S. cerevisiae* (GenBank Accession No. NP_776649) and *Yarrowia* was performed. It is clear that the corresponding Ser-79 site of the rat ACC is not present in the *Yarrowia* ACC. Putative Hyd-(Xaa-Bas)-Xaa-Xaa-Ser/Thr-Xaa-Xaa-Xaa-Hyd (SEQ ID NO:148) consensus phosphorylation sites within the *Yarrowia* ACC protein correspond to amino acids 711-719, 1173-1182, 1452-1462, 1612-1621, 1863-1873, 1880-1889, 2033-2041 and/or 2109-2119 of SEQ ID NO:150.

Based on the conserved mechanism for ACC regulation in both mammals and *S. cerevisiae*, it is hypothesized that the enzymatic activity of *Yarrowia lipolytica*'s ACC is similarly regulated by the heterotrimeric SNF1 protein kinase by phosphorylation (i.e., ACC activity is increased when the AMPK/Snf1 family kinase site of ACC is not phosphorylated). If a mutant ACC can be created that can not be phosphorylated (e.g., by replacing the Ser/Thr phosphorylation site(s) to an unphosphorylatable neutral residue such as Ala), then the heterotrimeric SNF1 protein kinase will no longer be able to down-regulate the activity of ACC, thereby enabling increased lipid production in the cell.

Interestingly, the activity of the YlACC1 gene (locus YALI0C11407g; SEQ ID NO:149) was up-regulated 1.36-fold in snf1Δ strains, as compared to the control strains (Example 11), while the YlFAS2 gene (locus YALI0C11407g, encoding the α-subunit of fatty acid synthetase, responsible for catalyzing the synthesis of long-chain saturated fatty acids; EC 2.3.1.41) was up-regulated 1.31-fold n snf1Δ strains. This may suggest that the transcription of the two key enzymes in lipid biosynthesis are regulated by Snf1, in addition to the post-translational control of ACC by Snf1.

Construction Of pYRH_YlACC: Plasmid pYRH_YlACC will be constructed to overexpress ORF YALI0C11407g (SEQ ID NO:149) encoding YlACC. Plasmid pYRH_YlACC will be derived from plasmid pZuFmEaD5s (FIG. 8B; SEQ ID NO:92; described in Example 6 of U.S. Pat. Pub. No. 2008-0274521-A1, hereby incorporated herein by reference). Specifically, a 0.4 kB fragment of the YlACC gene will be amplified by PCR (General Methods) from the *Y. lipolytica* genome using primers ACC1-F (SEQ ID NO:188) and ACC-NotR (SEQ ID NO:189). Another 6.9 kB fragment of the YlACC gene will be amplified by PCR (General Methods) using primers ACC-NotF (SEQ ID NO:190) and ACC1-R (SEQ ID NO:191). The amplified 0.4 kB fragment will be digested with NcoI-NotI, while the 6.9 kB fragment with be digested with NotI. The purified fragments will be used to replace the NcoI/NotI fragment of pZuFmEaD5s (SEQ ID NO:92), thereby producing pYRH_YlACC. Thus, pYRH_YlACC will contain a chimeric FBAINm::YlACC::Pex20 gene.

Identification Of The AMPK/SNF1 Phosphorylation Sites In ACC By Site-Directed Mutagenesis: Single amino acid mutations will be carried out using pYRH_YlACC as the template to individually mutate Ser-715, Ser-1178, Thr-1458, Ser-1617, Thr-1869, Ser-1885, Ser-2037 or Ser-2115 of YlACC (SEQ ID NO:150) by site-directed mutagenesis (QuickChange Kit, Stratagene, Calif.), thereby generating an Ala substitution and creating a series of YlACC* mutants (i.e., YlACC*-S715A, YlACC*-S1178A, YlACC*-T1458A, YlACC*-S1617A, YlACC*-T1869A, YlACC*-S1885A, YlACC*-S2037A and YlACC*-S2115A). Following mutagenesis, the mutant YlACC* plasmids will be linearlized, isolated and then transformed into strain *Y. lipolytica* Y4184U (General Methods), thereby producing strains Y4184U+YlACC*-S715A, Y4184U+YlACC*-S1178A, Y4184U+YlACC*-T1458A, Y4184U+YlACC*-S1617A, Y4184U+YlACC*-T1869A, Y4184U+YlACC*-S1885A, Y4184U+YlACC*-S2037A and Y4184U+YlACC*-S2115A.

The effect of YlACC* overexpression on accumulated lipid level will be determined and compared, as described in previous Examples. The mutant Y4184U strain that demonstrates increased total lipid (measured as percent of the total dry cell weight ["TFAs % DCW"]) as compared to cells whose native ACC had not been mutated, will correspond to the mutant ACC having a mutation in the AMPK/Snf1 phosphorylation site(s).

EXAMPLE 16

Manipulation of Diacylglycerol Acyltransferase ["DGAT"] Phosphorylation Site in *Yarrowia lipolytica* Increases Total Accumulated Lipid The present Example describes the identification of the heterotrimeric SNF1 protein kinase phosphorylation site(s) within diacylglycerol acyltransferase ["DGAT"], mutation of this site(s) to produce a mutant DGAT protein that can not be phosphorylated, synthesis of a vector suitable to overexpress the mutant DGAT* protein, and isolation of *Y. lipolytica* strain Y4184U+DGAT*. The effect of YlDGAT* overexpression on accumulated lipid level will be determined and compared. YlDGAT* overexpression is expected to result in increased total lipid (measured as percent of the total dry cell weight ["TFAs % DCW"]) as compared to cells whose native DGAT had not been mutated.

Experimental Rationale For Manipulation Of Diacylglcerol Acyltransferase: Triacylglycerols ["TAGs"] are the main storage lipids in cells. Diacylglycerol acyltransferase ["DGAT"] (also known as an acyl-CoA-diacylglycerol acyltransferase or a diacylglycerol O-acyltransferase) (EC 2.3.1.20) is the enzyme exclusively committed to TAG biosynthesis, catalyzing the conversion of acyl-CoA and 1,2-diacylglycerol to TAG and CoA. Two families of DGAT enzymes exist: DGAT1 and DGAT2. The former family shares homology with the acyl-CoA:cholesterol acyltransferase ["ACAT"] gene family, while the latter family is unrelated (Lardizabal et al., *J. Biol. Chem.* 276(42):38862-28869 (2001)).

It has been suggested that DGAT may be one of the rate-limiting steps in lipid accumulation. Therefore, it is hypothesized that increasing DGAT activity will increase lipid accumulation. DGAT activity appears to be regulated by the heterotrimeric SNF1 protein kinase by phosphorylation, in a manner similar to that described in Example 15 for ACC.

More specifically, studies with SnRK1 (the plant orthology of Snf1) in *Tropaeolum majus* (garden nasturtium) demonstrated that mutation of a putative phosphorylation site (i.e., Ser-197) within DGAT1 (GenBank Accession No. AY084052) increased its enzyme activity between 38%-80% (Xu, Jingyu et al., *Plant Biotech. J.,* 6(8):799-818 (2008)). Additionally, when *A. thaliana* was transformed with a construct containing the modified DGAT1 (i.e., having a Ser197Ala mutation), seed oil content was 20%-50% higher on a per seed basis. Xu et al. concluded that "... alteration of this putative serine/threonine protein kinase site can be exploited to enhance DGAT1 activity, and expression of mutated DGAT1 can be used to enhance oil content." Unfortunately, Ser-197 of the *T. majus* DGAT is not conserved between plants and fungal species, although putative SnRK1 phosphorylation sites have also been found in DGATs from other plants.

Determination Of Phosphorylation Of DGAT By SNF1 Protein Kinase: To determine if the *Yarrowia lipolytica* and/or *Saccharomyces cereivisae* genes encoding DGAT are phosphorylated by the heterotrimeric SNF1 protein kinase, the DGAT1 and/or DGAT2 will be expressed from a bacterial expression vector and purified by an affinity purification method. More specifically, GenBank Accession No. NC_001147 (locus NP_014888) encodes the *S. cerevisiae* DGAT2 enzyme (which together with PDAT is responsible for 95% of oil biosynthesis in this organism [Sandager, L. et al., *J. Biol. Chem.,* 277(8):6478-6482 (2002); Oelkers et. al., *J. Biol. Chem.,* 277:8877 (2002)]; the *Y. lipolytica* DGAT2 (SEQ ID NO:184) is described in U.S. Pat. No. 7,267,976, while the *Y. lipolytica* DGAT1 (SEQ ID NO:182) is described in U.S. Pat. No. 7,273,746. One of skill in the art will readily be able to amplify these genes by PCR and clone them into an appropriate expression vector, such as pET-32 (Merck-Novagen, Darmstadt, Germany), prior to expression in a commercially available strain of *E. coli*, such as BL21 (Promega, Madison, Wis.). A commercially available kit, such as Ni-NTA Spin Columns (Qiagen, Valencia, Calif.), would permit facile affinity purification.

*S. cereivisae* Snf1 protein kinase and/or *Y. lipolytica* Snf1 protein kinase will be partially purified, and an in vitro kinase assay will then be performed, such as described in Vincent, O. and M. Carlson (*EMBO J.,* 18(23):6672 (1999)) and Hong, S.-P., et al. (*Proc. Natl. Acad. Sci. U.S.A.,* 100:8839-8843 (2003)). If this experimental work confirms that DGAT1 or DGAT2 is indeed phosphorylated by the heterotrimeric SNF1 protein kinase, then putative Snf1 phosphorylation sites within the DGAT will be selected for mutagenesis.

Identification Of The AMPK/SNF1 Phosphorylation Sites In DGAT By Site-Directed Mutagenesis: An overexpression plasmid comprising a chimeric FBAINm::YlDGAT::Pex20 gene will be constructed in a manner similar to that described for overexpression of YlACC in Example 15. Then, single amino acid mutations will be carried out using the expression plasmid as the template to individually mutate putative Ser/Thr phosphorylation sites within YlDGAT by site-directed mutagenesis (QuickChange Kit, Stratagene, Calif.), thereby generating an Ala substitution and creating a series of YlDGAT* mutants. Following mutagenesis, the mutant YlDGAT* plasmids will be linearized, isolated and then transformed into strain *Y. lipolytica* Y4184U (General Methods), thereby producing various Y4184U+YlDGAT* strains.

The effect of YlDGAT* overexpression on accumulated lipid level will be determined and compared, as described in previous Examples. The mutant Y4184U strain that demonstrates increased total lipid (measured as percent of the total dry cell weight ["TFAs % DCW"]) as compared to cells whose native DGAT had not been mutated, will correspond to the mutant DGAT having a mutation in the AMPK/Snf1 phosphorylation site(s), if indeed DGAT is phosphorylated for its deactivation by the heterotrimeric SNF1 protein kinase.

SEQUENCE LISTING (191 sequences)

SEQ ID NO: 1 - DNA, 2587 bp, Saccharomyces cerevisiae
  CDS (391)..(2292): GenBank Accession No. M13971
ctgcagtttttctcgtagcggaaggggatggaaatttttaacgtaaaagaaagttggtaagagtatggcacatcaacaggtagcgttataggggccaagacatagctttgggcttagtactgtaggcttgttaccagaactttcatttatcgaaatattcttttttcacatttcctcttactgcgcattcgtgtccaaacagtcattcaggaagtataacgataaacaatagattgaagcctgaaaaaaaaaaaaaaagcacgacaatagaaattgtttcagtgtcattggcttttgataatatatagaggctgtttcaataatcatagcgaaagaaatagaagtttttttttgtaacaagttttgctacactcccttaataaagtcaacatgagcagtaacaacaacacaaacacagcacctgccaatgcaaattctagccaccaccaccaccatcaccaccatcaccaccaccatcacggtcatggcggaagcaactcgacgctaaacaatcccaagtcgtccttagcggatggtgcacatatcgggaactaccaaatcgtcaaaacgctgggagaggggtcctttggtaaagttaaattggcatatcataccactacgggccaaaaagttgctctaaaaatcattaataagaaggttttggcaaagagtgatatgcagggcagaattgaaagagaaatatcttatctgagactcttaagacacccccacatcatcaaactgtatgatgttatcaaatccaaagatgaaatcattatggttatagagtacgccgggaacgaattgtttgactatattgttcagagagacaaaatgagcgagcaagaggcaagaagatttttccagcagatcatcagtgccgtcgagtactgccataggcacaaaattgtccatagagatctgaagcctgaaaacttactactagatgagcatctgaatgtaaagattgccgattttggtttgtcaaacatcatgactgatggtaatttcttaaagacttcttgtggttctcccaattatgcggctcctgaagttatcagcggtaagctgtacgcaggcccagaagtggacgtgtggtcatgtggggttatcctttatgttatgctttgtcgtcgtctaccgtttgacgatgaaagcatcccagtgcttttcaagaatatcagcaacggtgtttacaccttgcctaaatttttatctcctggagctgctgggctaatcaaaagaatgttaatcgttaatccattgaacagaataagcattcatgaaattatgcaagacgattggttcaaagttgacctgccagaatatctacttccaccagatttgaaaccacacccagaagaagagaatgaaaataatgactcaaaaaaggatggcagcagcccagataacgatgaaattgatgacaaccttgtcaatattttatcatcgaccatgggttacgaaaaagacgagatttatgagtccttagaatcatcagaagacactcctgcattcaacgaaattagggacgcgtacatgttgattaaggagaataaatctttgatcaaggatatgaaggcaaacaaaagcgtcagtgatgaactggatacctttctgtcccagtcacctccaacttttcaacaacaaagcaaatcccatcaaaagagtcaagtagatcatgaaactgccaagcaacacgcaagaaggatggcaagtgctatcactcaacaaaggacatatcaccaatcacccttcatggatcagtataaagaagaagactctacagtttccattttgcctacatctttacctcagatccacagagctaatatgttagcacaaggttcgccagctgcctctaaaatatctcctcttgtaacgaaaaaatctaaaacgagatggcattttggtatacgatctcgctcatatccattagacgttatgggtgaaatttatattgccttgaagaatttgggtgccgaatgggccaagccatctgaagaggatttatggactatcaaattaaggtggaaatatgatattggaaacaagacaaacactaatgaaaaaatacctgatttaatgaaaatggtaattcaattatttcaaattgaaaccaataattatttggtggatttcaaatttgacggctgggaaagtagttatggagatgatactactgtttctaatatttctgaagatgaaatgagtactttttcagcctacccatttttacatttaacaacaaaactaattatggaattagccgttaacagtcaaagcaattgatggtggaacgtaaaagaatgatatggaagttcccttttttttatgtatcgtaacgtatttgcaacatctttataatatccctttgtataaagtaaacaatcttgattaaataaacctgaacataatttattgatgtgaatgaacttttattggcattatttcttcggatgaaaagcaaatttcacgctctatgagaaaaattgaaaacgctattctatgtgaaaatagagatgagtactactagtggctacaataaaaatactgaacctttgacaatcgtacaacaaaaggatcc

SEQ ID NO: 2 - protein, 633 aa, Saccharomyces cerevisiae
MSSNNNTNTAPANANSSHHHHHHHHHHHHHGHGGSNSTLNNPKSSLADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDLKPHPEEENENNDSKKDGSSPDNDEIDDNLVNILSSTMGYEKDEIYESLESSEDTPAFNEIRDAYMLIKENKSLIKDMKANKSVSDELDTFLSQSPPTFQQQSKSHQKSQVDHETAKQHARRMASAITQQRTYHQSPFMDQYKEEDSTVSILPTSLPQIHRANMLAQGSPAASKISPLVTKKSKTRWHFGIRSRSYPLDVMGEIYIALKNLGAEWAKPSEEDLWTIKLRWKYDIGNKTNTNEKIPDLMKMVIQLFQIETNNYLVDFKFDGWESSYGDDTTVSNISEDEMSTFSAYPFLHLTTKLIMELAVNSQSN

SEQ ID NO: 3 - DNA, 1434 bp, Saccharomyces cerevisiae
  CDS (303)..(1271): GenBank Accession No. M30470
aagcttaagaaataaaagtaatgaaccttgagaatacatcaagatataactcatcacatgttaaagaacccacacaccacacgcgcgagaactgggagggagagaaatttagcaaataacaaaatttaggccttggaagaaaccatagcaatgcaataatcgttattaacataatatctacattgagaacttcttgggctagtggttttgctgcaaactggaaaattgtatcaatcttttaacgttagctaaacatcttctgctgtgttagcattaggaggaagcgaaaaggaaaatacataatgaaaccgacacaggattcacaagaaaaggtttctattgaacagcagttagctgtagaatcgataaggaagtttttgaactcgaaaacatcttatgacgtgttgcctgtttcttaccgtttaattgtcttggacacctcgttgttagtgaagaaatcactgaatgttcttttgcaaaatagcattgtctctgcgccattatgggactccaagacttccaggttcgctggacttctaactactacagattttattaatgtcatccagtattacttctccaatccagataagttcgaattagtagacaaattacagttagatggattaaaagatatagagcgtgctctcggtgttgatcaactagatacagcttcaattcatccttctagacccttatttgaggcgtgtcttaagatgttagaatcaagaagtggtagaataccactgatcgatcaagatgaagagacacatagagaaattgtcgttagtgttcttacgcaatatagaattctgaagttcgttgctttaaattgcagggaaacacattttctaaagattccaattggggacttgaacattattacgcaagataacatgaaaagctgtcaaatgaccactccggtcatagacgtcattcagatgcttacccaaggtcgggtttcttccgtccctattattgacgaaaacggctacttaatcaacgtatatgaagcatacgatgtcctaggcttgataaaaggaggcatctacaacgacctgtcattgagcgtcggagaagcccttatgaggagaagtgatgattttgagggtgtttatacatgcactaagaatgataaattatctactattatggataacatcagaaaagcaagggtgcatagattctttgtagttgatgacgtcggacggttggttggtgtcttgacgttaagcgatattctcaaatatatccttctaggtagcaactgaaacgagccgatgagatttttgtgtacatactataaataaatgcaactaataaagtcatgattaatcagtcatgcatacttcatctgaccaatatattttcatcttgcttattttgggtataattcggcggaaattcggttataaagcgaagtgaaaaatcgat

SEQ ID NO: 4 - protein, 322 aa, Saccharomyces cerevisiae
MKPTQDSQEKVSIEQQLAVESIRKFLNSKTSYDVLPVSYRLIVLDTSLLVKKSLNVLLQNSIVSAPLWDSKTSRFAGLLTTTDFINVIQYYFSNPDKFELVDKLQLDGLKDIERALGVDQLDTASIHPSRPLFEACLKMLESRSGRIPLIDQDEETHREIVVSVLTQYRILKFVALNCRETHFLKIPIGDLNIITQDNMKSCQMTTPVIDVIQMLTQGRVSSVPIIDENGYLINVYEAYDVLGLIKGGIYNDLSLSVGEALMRRSDDFEGVYTCTKNDKLSTIMDNIRKARVHRFFVVDDVGRLVGVLTLSDILKYILLGSN

SEQ ID NO: 5 - DNA, 3279 bp, Saccharomyces cerevisiae
  CDS (123)..(2714): GenBank Accession No. M90531
aacatatcttgagtatacataatgttggatgagagcatgtaatattgatcgctttgtacgatgattataccttttttgtctttttaccattgtctctgatggaatactattgacaattaacaatggtagatatatccgatacaagtggatacctacataaacaaggtgtcttacctagtgtttctttcatttgcacttctttttttgcgtgtggactgacatcttggaaagttgaactgtcatattatatagttgttgcagccgccatgggaaacagtccttctactcaggatccatcgcattcaaccaaaaaggagcatggacatcattttcatgatgcattcaataaagatcgtcagggaagcataacctctcaactgtttaacaataggaagagtactcataagagacgcgccagtcatactagcgaacataatggtgccattccccctagaatgcaattacttgcatctcacgatccatcgacagattgtgatgggcgcatgagcagtgatactactatcgataagggcccgtcccatctattcaaaaaggattattctttgtcctctgccgcagacgtaaatgacactacgttggccaatttgactttaagtgatgatcacgatgtgggtgcacccgaagagcaggtgaaatctccgtcgtttttgagcccaggtccatcaatggccactgtcaaacgaactaaaagtgatctggatgatctgtctactttgaattacaccatggttgacgaaacaacagaaaatgaaagaaacgacaaaccacaccatgaaaggcatcgctcaagcatcatagctttgaaaaaaaatcttttagaaagttcagctactgcttccccttctccaacgaggtcttcatcggtgcattcagcatcacttcccgccttgaccaagacggattccattgatattcctgtaagacaaccctattcaaagaaaccatctatccatgcataccaatatcaatatctcaataacgacgaaacattttctgagaactctcaaatggataaagagggaaacagtgatagtgtagatgcagaagcaggcgtacttcaaagtgaagatatggttttgaaccagtctcttttacaaaatgctttaaaaaaggatatgcaacgtctttcaagggtgaattcctctaattcaatgtatactgcagaaaggataagccacgctaataacaatggaaatattgaaaataacacccgtaacaagggaaacgcgggaggctccaacgacgattttaccgcacctatatctgctactgcaaaaatgatgatgaaactgtacggtgataagaccttgatggaaagagatttaaataagcaccataataagacaaagaaagcccagaataaaaaaataaggtcggtttcaaattcgagaagatcctcatttgcttctttgcattctttacaatcaagaaagagtatcttaacaaacggtttgaatttgcagcctttgcatccactacatccaattattaacgacaatgaaagtcaatactctgcaccgcagcatagagaaatatcgcatcactctaattccatgtcgagtatgtcttcaatatcatcaacaaactccaccgaaaatactttagttgttctaaaatggaaagacgatggtaccgtggctgcaaccacggaagtctttatagtaagcacggatattgcttctgctcttaaagagcaaagagagcttaccttggatgagaatgcaagtttagactcagaaaaacagttaaatcctaggatccgcatggtttatgatgatgtgcataaggaatggtttgttccagatctttttttgcctgcaggaatttatagactgcaattctccatcaatggtatattgactcactcaaattttcttcctacagctacggattcagaaggcaattttgtcaactggtttgaagtattgcccggttatcatacgatcgagccatttagaaacgaagcagacatcgactcgcaagtagagccaacactggatgaagaattgcccaagagaccggaacttaaaagatttccttcttcctctcgaaaatcttcctactattctgctaagggtgttgaaaggccaagtacaccgttttcagattatagaggcttaagtaggtccagttcaataaatatgcgtgactcatttgtacgtctgaaggctagcagtttggatttgatggccgaggtcaagcctgagaggttggtgtattcgaacgaaataccaaatttatttaatataggtgacggctctacgatttctgtaaaaggagattctgatgacgtgcatccccaagaacctcccagctttacacatagagttgttgactgtaatcaagatgatttatttgctactttacagcaaggcggtaatattgatgcagaaacagcagaggcggtttttctaagtagatacccagttcctgacttgcccatatacctgaattcatcctatctgaacagaatactaaaccaaagcaatcagaattcagaatcacatgagagggatgaaggtgcgataaatcatattataccccacgtgaatttgaaccatttactgacaagcagtattagagatgaaataatcagcgtagcttgcactactagatatgaggggaaatttatcactcaagtagtttatgcaccttgttattataaaacacaaaagtctcagatcagtaattagaatctcaattcgcaatgattctcacgaactctattaattcaatttttttctttttgattcctatggctcctagaacgtttgcattccttttttttttgttctagtaggtatttcacgtcacgtttctggcaatccacttctcagcatgcgtggaatatactttaacatatccaacgaatttgctgcatattcttatgtaatagatagccgttcctaatgtgtaatggcctgctttgttatagaaatcatatataagtagtgattgagccgtaaaatcatctcatatgcccaatggaaaaccagtcatagtattatgaagcattcgcattattatatacctccatcttcccctgttattctgtctttgtatttaaaatcatttttacgaatagtgcggttgtcttggttgatgacgtaattctttgatatctacttatttacgcgttattggccttgagttattaatatcattattgatgttattactattcacgaacaagttgtataaattttcgaaattattattatcaccatctccacattgcatatatcgttgctcaataag

SEQ ID NO: 6 - protein, 863 aa, Saccharomyces cerevisiae
MVDISDTSGYLHKQGVLPSVSFICTSFFACGLTSWKVELSYYIVVAAAMGNSPSTQDPSHSTKKEHGHHFHDAFNKDRQGSITSQLFNNRKSTHKRRASHTSEHNGAIPPRMQLLASHDPSTDCDGRMSSDTTIDKGPSHLFKKDYSLSSAADVNDTTLANLTLSDDHDVGAPEEQVKSPSFLSPGPSMATVKRTKSDLDDLSTLNYTMVDETTENERNDKPHHERHRSSIIALKKNLLESSATASPSPTRSSSVHSASLPALTKTDSIDIPVRQPYSKKPSIHAYQYQYLNNDETFSENSQMDKEGNSDSVDAEAGVLQSEDMVLNQSLLQNALKKDMQRLSRVNSSNSMYTAERISHANNNGNIENNTRNKGNAGGSNDDFTAPISATAKMMMKLYGDKTLMERDLNKHHNKTKKAQNKKIRSVSNSRRSSFASLHSLQSRKSILTNGLNLQPLHPLHPIINDNESQYSAPQHREISHHSNSMSSMSSISSTNSTENTLVVLKWKDDGTVAATTEVFIVSTDIASALKEQRELTLDENASLDSEKQLNPRIRMVYDDVHKEWFVPDLFLPAGIYRLQFSINGILTHSNFLPTATDSEGNFVNWFEVLPGYHTIEPFRNEADIDSQVEPTLDEELPKRPELKRFPSSSRKSSYYSAKGVERPSTPFSDYRGLSRSSSINMRDSFVRLKASSLDLMAEVKPERLVYSNEIPNLFNIGDGSTISVKGDSDDVHPQEPPSFTHRVVDCNQDDLFATLQQGGNIDAETAEAVFLSRYPVPDLPIYLNSSYLNRILNQSNQNSESHERDEGAINHIIPHVNLNHLLTSSIRDEIISVACTTRYEGKFITQVVYAPCYYKTQKSQISN

SEQ ID NO: 7 - DNA, 1766 bp, Saccharomyces cerevisiae
  CDS (283)..(1530): GenBank Accession No. L31592
tgaaacaacttagcatataacgcgtacttacatagatagattaaatagataaccatgcatatcactaactagcatcgtcatgaatagcacgtttacctatacgaattgcggccggcatggtcttttatattgctcccttggaccgagtaaagatttaccttgcgttttcggatcgtcaaaatcttttagggaaaggataaatacaccacaagattcctgggaaatgaaaagtatctgaaataattgtgcttttggaagggtactgagagcagtgaagtttctatgggtactacgacaagtcatccagcccaaaaaaagcaaacaacaaaaaagtgtcgtgcacctatcatgagtgacgttagagaaaaacccagcaatgctcaaggctgcgaaccgcaagaaatggatgctgtgagcaagaaagttactgaactgagcttaaataaatgttcagattcccaagacgcggggcagccttcaagggagggatctattaccaaaaaaaaatcgacgttattgctgcgtgatgaggacgagcccactatgccaaagctatctgttatggaaactgctgtggacactgactctgggtcttcgtctactagcgatgatgaagagggagatattattgcccagacgacagagcccaagcaagatgccagtcctgatgatgatcgctcaggccattcttcgcccagagaggagggacaacagcaaatacgtgccaaagaagcttcgggaggtccaagtgaaatcaagagctcattaatggttcccgtggagataaggtggcagcaaggtggttcaaaagtttacgtgacaggctcattcaccaaatggaggaaaatgatcggtttgatacctgattctgacaataatggctcatttcatgtgaagctaaggctgcttccaggcacacatagattcagatttatagtggataatgagcttagagttagtgatttcctgcccacagcaactgatcagatgggaaacttcgtcaattacatagaagtcaggcaaccagaaaaaaacccaactaacgaaaagataaggtccaaggaagcagattccatgcgacctcccaccagcgatcgatcctcaattgctctacaaattggtaaggatccagacgattttggtgacggatatacaaggtttcatgaagatctgtcacccagacctccgttggaatatacaacagacattcccgccgtgtttactgacccgtctgtcatggaacgatactattataccttggatcgtcagcaaagcaatactgatacgtcatggctgacaccaccccaattacctcctcagttggagaatgttatcttgaataaatactatgccacgcaagaccagttcaacgagaacaactcaggcgctctgcccattccgaaccatgtggtgcttaaccacttggttactagtagcattaagcacaatacactttgtgtagcctccatcgttcgatataaacagaaatatgtcacccagattctttatacgcccatagagtcctcgtaatccgggattcctactttttaaaggcgtattgtatatatttttggcagctatggcacactaatttctatttccaatttagtgtaagcagagatatagaagcatataacataatgatttactaatgggctcagtactctcaatgcttattgttatcacaaaccacgatactaatacccggaagtcgcgtgatctttttttttttcggaaaatgagaatcgccacttttctaacgaaag

SEQ ID NO: 8 - protein, 415 aa, Saccharomyces cerevisiae
MGTTTSHPAQKKQTTKKCRAPIMSDVREKPSNAQGCEPQEMDAVSKKVTELSLNKCSDSQDAGQPSREGSITKKKSTLLLRDEDEPTMPKLSVMETAVDTDSGSSSTSDDEEGDIIAQTTEPKQDASPDDDRSGHSSPREEGQQQIRAKEASGGPSEIKSSLMVPVEIRWQQGGSKVYVTGSFTKWRKMIGLIPDSDNNGSFHVKLRLLPGTHRFRFIVDNELRVSDFLPTATDQMGNFVNYIEVRQPEKNPTNEKIRSKEADSMRPPTSDRSSIALQIGKDPDDFGDGYTRFHEDLSPRPPLEYTTDIPAVFTDPSVMERYYYTLDRQQSNTDTSWLTPPQLPPQLENVILNKYYATQDQFNENNSGALPIPNHVVLNHLVTSSIKHNTLCVASIVRYKQKYVTQILYTPIESS

SEQ ID NO: 9 - DNA, 2214 bp, Saccharomyces cerevisiae
  CDS (742)..(1995): GenBank Accession No. X72893
tcgaaattaaccctcactaaagggaacaaaagctggtaccgggccccccctcgcgataagcttgcaggagcaatcataagtacaaggttaatgctgttagcagagggagacaacatgaaagggcacaatttcatatatctggagatgatgaggacagtaacgttcaccgccaagaatcaagagcatccaacacaagtcccaatgtatcattgcctccgataaagagcattttgcgacaaattgataatttcaacagtcgtccttcgttacttcagtaaataaacaagcagtaaataaaacgtatagaatataagaaggaaaataacaatgggttcttgaaacttgatatactttttcctggaatgaagacgcaaagaaaacctttggagaaaatcattgcaaatttaaaagctgtgcttcaaaaaacccatgtgagactgaaacatggtccagtggtcttcatccggaccggttcaaagtcctgctctaccttcaataatttgtctttaccgttaaaacacaggccacgctattttttttgttgcactaattttcatccttaagcgaccaatttgctcccctttggaaaagctcacgaaaaaacgtggcaaagaaaacaataccgatctcgtaggatttgggccactgttgtaatcgcaagtagagagcatcctagataagagctactatattttgtataaggtcgtttcctgcacaataataaattatctacactgaaatatggctggcgacaaccctgaaaacaaggatgcttccatgttagatgtcagtgacgcagctagcaacactacgattaatggtaaacatagcgccgattcaactaatgaggcttccctggcgtacactttttctcaaatgaacgtagataatcctaatgaattagagcctcagcatcctttaagacataaatcgagtttaatttttaacgacgatgatgacgatgaaatacctccatattcaaaccatgcggaaaatggttctggggagacctttgattctgatgatgatatcgatgctagcagctcgagtagtatcgacagcaacgaaggcgatatccacgatgcagatatgacaggaaataccttgcaaaaaatggattatcaaccatctcagcagcctgactcacttcaaaatcaaggctttcaacagcaacaagaacagcaacagggcactgtggaaggcaagaaaggaagagctatgatgtttccagttgacatcacttggcaacaggggggtaataaagtgtacgttactgggtcttttacgggatggagaaagatgatcgggttagtaccagtccctggacagcctggacttatgcatgtaaaattacagctgcctccaggtactcatcgtttcagatttattgttgacaatgagttaagattcagtgattatttacctaccgcaaccgaccaaatgggaaacttcgtcaactatatggaagtgagcgcaccgcctgattgggggaatgaacctcagcagcatctggctgaaaaaaaagcgaatcatgtagatgatagcaaattgagtaagagacctatgagcgctcgctcgagaatcgcattggagatagaaaaggaaccagatgacatgggcgatggttacactcgttttcacgatgagacccccgctaaacctaatttagagtacactcaagatatacctgctgtgttcaccgacccaaatgtaatggaacaatattatttgacacttgatcagcagcaaaataatcaccaaaatatggcctggttgactcctccacaactgccacctcatttagaaaacgtcattttgaatagttactcaaacgcgcaaactgataatacgtctggcgcccttcccattccgaaccatgttatattgaaccatctggcgacaagcagtattaagcataatacattatgtgtcgcatccattgttaggtataaacaaaaatacgtgacccaaatactgtatacaccattgcaatagatatgattatagagcttatagctacatctttttagataaaagcgaagatgtttctgcgatttttccattatagctctcctcgatactaaatatcaaggtctacatgtaagtatttgtatatatgggttggaatgtatatacgtatatacgtacgtacgtagctatatgcacataattgttacgggatgtatatataaattagtagcattatagaagata

SEQ ID NO: 10 - protein, 417 aa, Saccharomyces cerevisiae
MAGDNPENKDASMLDVSDAASNTTINGKHSADSTNEASLAYTFSQMNVDNPNELEPQHPLRHKSSLIFNDDDDDEIPPYSNHAENGSGETFDSDDDIDASSSSSIDSNEGDIHDADMTGNTLQKMDYQPSQQPDSLQNQGFQQQQEQQQGTVEGKKGRAMMFPVDITWQQGGNKVYVTGSFTGWRKMIGLVPVPGQPGLMHVKLQLPPGTHRFRFIVDNELRFSDYLPTATDQMGNFVNYMEVSAPPDWGNEPQQHLAEKKANHVDDSKLSKRPMSARSRIALEIEKEPDDMGDGYTRFHDETPAKPNLEYTQDIPAVFTDPNVMEQYYLTLDQQQNNHQNMAWLTPPQLPPHLENVILNSYSNAQTDNTSGALPIPNHVILNHLATSSIKHNTLCVASIVRYKQKYVTQILYTPLQ

SEQ ID NO: 11 - DNA, 3429 bp, Saccharomyces cerevisiae
  CDS (1)..(3429): GenBank Accession No.  NC_001137 (REGION: 417277..420705 of chromosome V)
atggataggagtgataaaaaagttaacgtcgaagaggtcaatgtaccttcaaacttacaaatagaattagaaaaatcaggcaccagtagcagtgtatcactccgaagcccgactaagagtagcgctaccaatttggcgggcatggccgaaggtgcaagagataatgcatcaatagcgtcttcatcggtagattccctcaacatgctattagagcggcaaagagtaaggcagttaaaccatccacagcaccaacagcatataagtagttcactagctaagaccccgacaacgacttcatcattttgttcgagcgggagttctaagaataaagttaaggaaactaatcgaatatctctaacatacgacccggtgtcaaagaggaaagttttaaacacttatgagatcatcaaagaattaggccatggacaacatggaaaagtaaaattagcaagagatatattgagtaagcaattagtagcgattaaaatagtggatagacatgaaaagaaacagaggaagtttttcacgtttatcaaatcaagtaaaatatccgaaaatgataaaataaaacgagaaattgccattatgaaaaaatgccatcacaaacatgtcgtacaactgatagaagttctggatgatttaaaatcaagaaaaatttatttagttctagagtattgttctcgaggcgaggtaaaatggtgtccaccggattgtatggaatcagatgctaagggtccctctttactaagttttcaagaaacgcgagagattttaagaggcgttgtgctcggcttagaatatctccattaccaaggaatcattcaccgagatattaagcctgccaacttattaatatcaggagatggcactgttaagatttccgattttggtgtttctttagctgctagcagcacgaatagttccgatagtagcgaatccttagacgagttagaattagccaaaacagtgggcacgcctgcattttttgctcccgaaatgtgcttgggtgaagatgcattcaccaggtataacttaacaaaggaaaatttatttcgtggttcttgcatctcattcatgatagatatttgggctgtgggtgtgaccttgtactgtcttctttttggaatgctgccttttttttctgattttgagctcaaattatttgaaaaaattgtaaacgacccgttaaaatttccaacatttaaagaaatacagtccaacaaagtatctaaagtatcttgtgaggaggaatacgaaatggcaaaggaccttttattgaaattgttagaaaaaaatccccaaaaaagaatgactatacctgccattaaaaaacatccttttgtttcatgggattttgaccacgtaccggagaacgatgaaaagttactatcttctgtccttgagcaaaaattacgtttccaatgtaaccaaactgatcaatttgaacccatttctatttcaaagcacgaattgaaaaacgctgtctccggtgtcgggaaaaaaatcaaagagtccgtactaaaaagtatcccgctaaaggatccgtcagatctctctaataaaaactaccttcatccaacggaaaccactaggggcagaggggatgccaatgttattgtcagcgaaggttcagtgttatcgaatattaaggaattaagtgctaatgatggatgtttgaacactgatagcgacactaatattaatatcaacgacgatgatcattatagtggtgatgataacgatggacatttaacgaaaagagaactagaacgagaattaaacaaattcgatgataaacacgaggccggaaatatggttaatttacctatcaattcctcatttgcatccttggacagcttctacatagataattttgcgatggctagaatgggaatgagttctccagaagcgggagattcggtttcgtctgtaccaaaccttccttctgcaccgtcttcaacaaggcttggacgatcaccagtctttagtggagtcaccaaccaaccaagtccaattcgccccgttttgccacaacaaaagtcatcgttttgtgcaacaggtcggtatgataagagtcacaatagtcttcttagaaattcttcatctcatctaacgtcatacaactccggcagaccatcttcaaggactggccgaatgaattcacgcaaccaaaacttaccgaaaataccaaatagcctttcaaaaatctcaacaacgaaattgactgaactaagagttccaaaggattcagaaattccatcacctgcaaaaaaccctaacgctgatcgtttgagaaggtttcccgtaaagaaaaataccaaaacacccgccataaaagatcctccgagaataaacattaatagcagcgataagtcaggctccaaaaattctcctataaaatccttataccaacggatgaaacagtctaaggataattcaaaaaccttcgaggtacgtagaggaaactttttcagtcattttaatggagatgatgatgatagcagtagccagtcgtccgtaaccagttctggttcagaatctgattctgaattatcatccacttcatcgtcctgtacatctggaacccaatctcggaatagctccaacaataatgcatattcagaaacggagtcattacctttcgagtttggtgttgattcagaagatggaagtggagtattattaagagatttacctaacgaagatcaaataaggccgtttctggatatacaaccatgtcgacgcatgaaagttaaaagttcattgaacctcgaaccaccttctgtctcatcttcttcatcttcatcctccgacgaagatgagctaattttaaatgtcgggactgcaggtcatcgaagaaggcataattcttcaaaacttagtgaactatccaatagtccgcagaagggatcaaataatttcatgtattccaatggaagtgttcatgacagtgagacgacgataacgccgcaaaatatggatgacttgacgctgcatcaggcactgagccgcagccaacccattagtaagcctggcccattagtattaccaaagcgtttagaccaaaagaaagctacgacggaaacctcaaatttaacagatatcgttgaatttaacggtaataacgatcatcgaaaggacaaaaatttcgataaagttctttattcaagggacttgttaaaagatgctctaagttccactaatgcaggcagaaggagatccataccttcaaataaaataagaggacgaaaggacgcaagtattaccatgagtactaatgttggtaatgatgaacatgctagaaataccagctgccatggtgataaaggacaagaaaatggcgctataaaacaaaggacccatgaaagatcgcgatctttaacagtcgctgaactaaatgaagagaagagaaggagtgcacttccatga

SEQ ID NO: 12 - protein, 1142 aa, Saccharomyces cerevisiae
MDRSDKKVNVEEVNVPSNLQIELEKSGTSSSVSLRSPTKSSATNLAGMAEGARDNASIASSSVDSLNMLLERQRVRQLNHPQHQQHISSSLAKTPTTTSSFCSSGSSKNKVKETNRISLTYDPVSKRKVLNTYEIIKELGHGQHGKVKLARDILSKQLVAIKIVDRHEKKQRKFFTFIKSSKISENDKIKREIAIMKKCHHKHVVQLIEVLDDLKSRKIYLVLEYCSRGEVKWCPPDCMESDAKGPSLLSFQETREILRGVVLGLEYLHYQGIIHRDIKPANLLISGDGTVKISDFGVSLAASSTNSSDSSESLDELELAKTVGTPAFFAPEMCLGEDAFTRYNLTKENLFRGSCISFMIDIWAVGVTLYCLLFGMLPFFSDFELKLFEKIVNDPLKFPTFKEIQSNKVSKVSCEEEYEMAKDLLLKLLEKNPQKRMTIPAIKKHPFVSWDFDHVPENDEKLLSSVLEQKLRFQCNQTDQFEPISISKHELKNAVSGVGKKIKESVLKSIPLKDPSDLSNKNYLHPTETTRGRGDANVIVSEGSVLSNIKELSANDGCLNTDSDTNININDDDHYSGDDNDGHLTKRELERELNKFDDKHEAGNMVNLPINSSFASLDSFYIDNFAMARMGMSSPEAGDSVSSVPNLPSAPSSTRLGRSPVFSGVTNQPSPIRPVLPQQKSSFCATGRYDKSHNSLLRNSSSHLTSYNSGRPSSRTGRMNSRNQNLPKIPNSLSKISTTKLTELRVPKDSEIPSPAKNPNADRLRRFPVKKNTKTPAIKDPPRININSSDKSGSKNSPIKSLYQRMKQSKDNSKTFEVRRGNFFSHFNGDDDDSSSQSSVTSSGSESDSELSSTSSSCTSGTQSRNSSNNNAYSETESLPFEFGVDSEDGSGVLLRDLPNEDQIRPFLDIQPCRRMKVKSSLNLEPPSVSSSSSSSSDEDELILNVGTAGHRRRHNSSKLSELSNSPQKGSNNFMYSNGSVHDSETTITPQNMDDLTLHQALSRSQPISKPGPLVLPKRLDQKKATTETSNLTDIVEFNGNNDHRKDKNFDKVLYSRDLLKDALSSTNAGRRRSIPSNKIRGRKDASITMSTNVGNDEHARNTSCHGDKGQENGAIKQRTHERSRSLTVAELNEEKRRSALP

SEQ ID NO: 13 - protein, 560 aa, Saccharomyces cerevisiae
  MISC_FEATURE (1)..(560): GenBank Accession No.  NP_011336
MVLLKEPVQPLPRSSLLYNNASNSSSRIKETRKVKLLYNPLTKRQILNNFEILATLGNGQYGKVKLARDLGTGALVAIKILNRFEKRSGYSLQLKVENPRVNQEIEVMKRCHHENVVELYEILNDPESTKVYLVLEYCSRGPVKWCPENKMEIKAVGPSILTFQQSRKVVLDVVSGLEYLHSQGITHRDIKPSNLLISSNGTVKISDFGVAMSTATGSTNIQSSHEQLLKSRALGTPAFFAPELCSTEKEYSCSSAIDIWSLGVTIYCLLFGKLPFNANSGLELFDSIINKPLEFPSYEEMLNGATSGITMEEYTDAKDLLKKLLQKDPDKRIKLADIKVHPFMCHYGKSDAASVLTNLETFHELKVSPPSSCKRVELVSLPVNSSFASLDSVYMENFDHNNLRTGADRNSTYSPSIYDANTLSPSAYHNIGSRESSYSSFSSFTSSTAFASQISIQDAPAIGDQQCLIGESGSSLRVNSCEFPQYTTMSPVGEYPFESTEASLSSTLTPVGNVPQRIKAHLVEGKSNSKDDLRIEADASLVFEASDAQRTRRRMSLYKL

SEQ ID NO: 14 - DNA, 2105 bp, Saccharomyces cerevisiae
  CDS (301)..(1992): GenBank Accession No. M81258
gatccttcttgaagtagctattaagttgttcgaaatgaagtaattattaaaatagaagtaaatcattaaatgatgccgctcaacagaggttatgccaaattagtatatagcatgattttacatcactttaaacgtataatttgtgaatgatgaggtagcaacaaataaacaatgcaacagtctctagtcctatgaactaatttggccttgaaaccccccgatgatacttctttaggtgttacaacttactcgcatagatattatttttgacgccaggttaacaataattacttagcatgaatgtcaccgcgacagcttataccgacattaattccggaatgggcaccattatcccagcaatcgtgcataagagaggatgagttagatagtcccccgataacgcctacgagccagacatcttcatttggttcttctttttctcaacagaaaccaacctatagtacaattataggagaaaatatacacacgatcctggatgaaattcgaccatatgtgaaaaaaataactgttagtgaccaagataagaaaactataaaccaatatacgctaggagtctctgcaggaagtggacaatttggttatgtacgaaaagcgtacagttctactttaggcaaggttgttgctgtcaagattataccaaaaaaaccttggaatgcccagcaatattcagtaaatcaagtaatgaggcaaatccagctttggaagagtaaaggaaaaataacgacaaatatgagtggtaatgaggctatgagacttatgaatatcgaaaaatgtaggtgggaaatttttgcggcttcaagacttcgaaataatgttcatattgtgcgactaatagaatgcttggactctcctttcagcgaatctatctggatagtcactaattggtgcagccttggtgaactacagtggaaacgtgacgatgatgaagatattttaccgcaatggaaaaaaattgtgatttcaaattgtagtgtttctacatttgccaaaaaaatcctggaggatatgacaaaagggttggaatatttgcattctcagggttgtattcatcgtgatatcaaaccgtccaatattttattggatgaagaagaaaaagtagcgaaactttctgattttggaagttgtattttcactccccaatcattacctttcagcgatgctaattttgaagattgttttcagagggaattgaacaaaattgttggtactccggcatttattgcaccagagctatgtcatttgggcaattccaaaagagattttgtgacggatggctttaagttggatatttggtcattgggagtgacactatactgcttactgtacaacgagctgccatttttcggggaaaatgaattcgaaacctaccacaaaatcatcgaagtatcattgagttccaaaataaatggtaatactttaaacgatttagtcattaaaaggttattgtataaagacgttactttacgcataagtattcaggatttagtaaaggttttgtcgcgtgaccagcccatagattctaggaatcacagtcaaatttcatcgtccagtgtgaaccccgtaagaaacgaaggtcctgtaagaagattttttggtaggctactgactaaaaaaggaaagaaaaagacctcaggaaaagggaaagacaaggtattggtatcagcaactagtaaagtaacaccttcgatacatatcgacgaggaaccggataaagaatgtttttcgacatcggaccttagatcttcgccagactcgagcgattattgttcatcgttaggggaggaagccattcaggttacggatttcttagatactttttgtaggtcaaatgaaagcttacctaatttgactgtcaataatgataagcagaattcggacatgaaaactgacagaaagcgagtcatcctctcattcgtcattgaaaatcccaacacctatcaaagccatgataagactaaagagttcccctaaagagaacgggaacagaacccatattaattgctcacaggacaaaccgagttccccactaatggataggactgttggaaagcgcacggttaataattcaggggctagaaagcttc

SEQ ID NO: 15 - protein, 563 aa, Saccharomyces cerevisiae
MSPRQLIPTLIPEWAPLSQQSCIREDELDSPPITPTSQTSSFGSSFSQQKPTYSTIIGENIHTILDEIRPYVKKITVSDQDKKTINQYTLGVSAGSGQFGYVRKAYSSTLGKVVAVKIIPKKPWNAQQYSVNQVMRQIQLWKSKGKITTNMSGNEAMRLMNIEKCRWEIFAASRLRNNVHIVRLIECLDSPFSESIWIVTNWCSLGELQWKRDDDEDILPQWKKIVISNCSVSTFAKKILEDMTKGLEYLHSQGCIHRDIKPSNILLDEEEKVAKLSDFGSCIFTPQSLPFSDANFEDCFQRELNKIVGTPAFIAPELCHLGNSKRDFVTDGFKLDIWSLGVTLYCLLYNELPFFGENEFETYHKIIEVSLSSKINGNTLNDLVIKRLLYKDVTLRISIQDLVKVLSRDQPIDSRNHSQISSSSVNPVRNEGPVRRFFGRLLTKKGKKKTSGKGKDKVLVSATSKVTPSIHIDEEPDKECFSTSDLRSSPDSSDYCSSLGEEAIQVTDFLDTFCRSNESLPNLTVNNDKQNSDMKTDRKRVILSFVIENPNTYQSHDKTKEFP

SEQ ID NO: 16 - DNA, 2501 bp, Kluyveromyces lactis
  CDS (350)..(2158): GenBank Accession No. X87975
cgctatatgcgttgatgcaatttctatgcgcacccgttctcggagcactgtccgaccgctttggccgccgatccccagtcctgctcgcttcgctacttggagccactatcgactacgcgatcatggcgaccacacccgtcctgtggatcaatgcgtaattgtagggcggatagaattgggttttgtgagactccagaaacgtcacactagtataagaattgcaagttttctaacaagttagtcaacttctcaattagaagacaactattctcagagtaaacaagatatccctctgttgaacgcaaactcttagtgaagactttacgagtacatactcatcagagaagatatgtcgcacgacccaaatcaacaacagccgcatggtggctcaggtcaaggccatcaccaacgccagctgactaaccacgcacaaggccaacatatcggtaagtatcaaatcatcaagaccttgggtgaaggatcatttggtaaagtgaaactggcgtaccatatctctacgggacaaaaagtggcattaaaaatcatcaataagaaggttctagccaagagtgatatgcaaggtagaatcgagagagagatttcgtacttacgtttgttgagacatccacacattatcaaattgtatgacgtgatcaaatcgaaggacgaaattatcatggtgattgagtatgctggtaatgaattatttgattatattgtccaaagagacaagatgcctgaacaagaagcaagaagatttttccaacagattattagcgcagtagattattgtcaccgtcataaaattgtgcatagagatttgaaaccagagaatttactattagacgaacatttgaacgttaagattgctgattttggtttatctaatataatgacagatggtaactttttgaagacttcatgtggttctccaaattatgcggccccagaagtcatcagcggtaaactatatgcaggtccagaggttgacgtttggtcttcaggggttatcttatacgtcatgttgtgtcgtaggttaccattcgatgacgaaagtatcccagtgttgtttaagaacattagcaatggtgtttacaccatacctaacttcctttcccaaggtgctgcgagcttaatcaaaaagatgctcatcgtcaatccagttaatagaattaccgtgcatgaaatcatgcaggatgaatggttcaaagttgatttacccgactacctagttcctgctgaaagcacccatcaagaaaactctgaaagcaaaacagaagatggcggcccatccgtgccactcgaactgatcgatgattcgttagttcaaacgctatcaaacactatgggttatgacgtagatgagatatatgaggctttagagtccgatgaagatcatccatctttaaatgaaatcagggatgcctatcagttaattaaagagaacagaaatttaatcaacgacatcaaggtgaacaagcaacaatctaatgacttggatactttcttatcgcaatctccacccactttcgaacaatccttgcatgcccccccgggctcaaaaaatcgacactcacaccgccattcaaagagaacacagcaacgtacatatcaatatcattatggaaatggttctcaggatggagacagcacgattgcaattttacctagctcgttaccacagatccatagagccaacatggtagcacaagggtcccaggctgctgctaagatttcaccattaagcgtgaaaaaatcaaaaacaaggtggcatttcggtatacgatcaagatcctatccattagacgttatgggagaaatatacattgcattgaaaaacttgggagccgaatgggcgaaaccatcagaagaggacctatggactattagagtccgttggagatataatatcgatatgcctgatgacgaaatgaagaacaagcagattccagatttaatgaagatggtaatccaattgttccaaattgagacaaataactacttagtggatttcaaatttgatggctgggagtccagtaacggtgtagtgtattcaagtcggaacgacgatgaaatgagtacgttcagtgcatacccctttctacatttagcaaccaggctgattatggaacttgcagtgaatagccaaggaagttgattttaaggttcatgaaattaaaaaaatactaacggataatatccaacgaagagtgtatataagtttgaatatttgcttaaagtttaagccttatatacatatcattaaataatgacaatcactatattatatgagaaattactcttagctcacaacactcgccgggaagaagaggaaaacaacatacatgtttttgacacatgaaaaaagaatgcatcggccgggaatcgaacccggggcccaacgatggcaacgttggattttaccactaaaccaccgatgctactttgttgtagttttcgtaagatagactgaagacaggccagacgaagggtcatgtgag

SEQ ID NO: 17 - protein, 602 aa, Kluyveromyces lactis
MSHDPNQQQPHGGSGQGHHQRQLTNHAQGQHIGKYQIIKTLGEGSFGKVKLAYHISTGQKVALKIINKKVLAKSDMQGRIEREISYLRLLRHPHIIKLYDVIKSKDEIIMVIEYAGNELFDYIVQRDKMPEQEARRFFQQIISAVDYCHRHKIVHRDLKPENLLLDEHLNVKIADFGLSNIMTDGNFLKTSCGSPNYAAPEVISGKLYAGPEVDVWSSGVILYVMLCRRLPFDDESIPVLFKNISNGVYTIPNFLSQGAASLIKKMLIVNPVNRITVHEIMQDEWFKVDLPDYLVPAESTHQENSESKTEDGGPSVPLELIDDSLVQTLSNTMGYDVDEIYEALESDEDHPSLNEIRDAYQLIKENRNLINDIKVNKQQSNDLDTFLSQSPPTFEQSLHAPPGSKNRHSHRHSKRTQQRTYQYHYGNGSQDGDSTIAILPSSLPQIHRANMVAQGSQAAAKISPLSVKKSKTRWHFGIRSRSYPLDVMGEIYIALKNLGAEWAKPSEEDLWTIRVRWRYNIDMPDDEMKNKQIPDLMKMVIQLFQIETNNYLVDFKFDGWESSNGVVYSSRNDDEMSTFSAYPFLHLATRLIMELAVNSQGS

SEQ ID NO: 18 - DNA, 1791 bp, Kluyveromyces lactis
  CDS (305)..(1765): GenBank Accession No. X75408
gagaagaactgtgcctttctcggcactatagatttcgtaccgataaggtcctttaccctctgtttcatgtcacgtgaacgaagtttccatctgtttattttgtcctttttcgaatttctgcaaattgatcaatcaagaaaacacataatatatatatatatatcgaaatccccagataacaacattgtttctgaaagttcaaataatgcataaagtagcaccgacggcacatttggtaactatttggcggaggtagcatagaggaaaacgttcaaaagtaccaagagactacctgaagaacttaatggggaatttacccagtcattccaacagaccacatcacaaacatccatcaactatgtctcagaacgttaaagatgtctctatggttgacatcaatgaagctatgaatgaaagacaggatgacacttcaaataaggtcgaaaccccaggagcatcctcgaaccttacccaatctctatcacaaatgaacattgatgacagaaatgagttaacaccacagctttcatccagaaaatccacgttgatatttaatgacgacttcgatgatatttcgaatcagcataagcacattgaacaccagaataattacgacgacggaagaatcatcactgacaatgaagatgaggatgaggatgttgtgaataatatcataacaggaccctctgatggatctgcatcctcgctttcagcagattcgccagctgccagttcacacagcgaagatggaagacatcaaaattcagcatacactaacaactctcaagaacaacatgccaacaaagtttcaggaaatcattacgatgggaacgtacaacatccaggccctgctattaatcagcagacgcaaccggtacctgaacgtagacctaccatggttcctgttgagataacgtggcaacaaggcggttccaaggtctatgtaacaggttccttcactggctggcgtaagatgattggccttgtacctgttactgacaaacctggagttttccatatcaagttacaattacctcccggtactcacagatttagattcatcgttgataatgaactccggttcagcgactttcttcccactgcaactgatcagatgggtaattttgttaattatcttgaaattgttccacctgagtcgatcgaaatgatgaattatgaactggatgcccaacaacagacacagcaaaagcaaaatatgcaaaatcaacaactctcagataatgtttctcaatctcagaaaattcgcgatcaaaccatccagtcacaggttagaaggcaaccatctcaaagtaaagatggcaaattaagtgccagatcccagcttgctttgcatattgaagaagaccctgatgatatgggaaacggatacacccgtttcaaagaggaacaacagctaaagaccgattatgagtatactcaggatatccctgctgtctttacagatccttcggtgatggaacagtattatctcacattagaccagcaacagaacaatcaacaaaatatgtcatggttaactcctccacaacttccacctcagttggagaatgttattctcaataattacaacaaaaatgctgaaccaggtagtgaaaataattcaggtgcgttgccaattcctaaccacgtcgttcttaatcatttagcaacgtcttctattaaacataatactttatgtgttgctagcatcgttagatacaaaagaaaatatgcaacacagatactatatgcgccattgcaatgaaaccactcctagagatttgattttat

SEQ ID NO: 19 - protein, 486 aa, Kluyveromyces lactis
MGNLPSHSNRPHHKHPSTMSQNVKDVSMVDINEAMNERQDDTSNKVETPGASSNLTQSLSQMNIDDRNELTPQLSSRKSTLIFNDDFDDISNQHKHIEHQNNYDDGRIITDNEDEDEDVVNNIITGPSDGSASSLSADSPAASSHSEDGRHQNSAYTNNSQEQHANKVSGNHYDGNVQHPGPAINQQTQPVPERRPTMVPVEITWQQGGSKVYVTGSFTGWRKMIGLVPVTDKPGVFHIKLQLPPGTHRFRFIVDNELRFSDFLPTATDQMGNFVNYLEIVPPESIEMMNYELDAQQQTQQKQNMQNQQLSDNVSQSQKIRDQTIQSQVRRQPSQSKDGKLSARSQLALHIEEDPDDMGNGYTRFKEEQQLKTDYEYTQDIPAVFTDPSVMEQYYLTLDQQQNNQQNMSWLTPPQLPPQLENVILNNYNKNAEPGSENNSGALPIPNHVVLNHLATSSIKHNTLCVASIVRYKRKYATQILYAPLQ

SEQ ID NO: 20 - DNA, 2351 bp, Candida albicans
  misc_feature (173)..(174): n is a, c, g, or t
  CDS (319)..(2181): GenBank Accession No. L78129
tgtcagaatcagtagagatagagcgaatcaatatatagaagaaggcattagttttgataactgtgttgttttactaatttgcatgctgcaaaaacaagctttatatccacacacataatgacaatgtatactttagtaaagtcgtgtaaatatcaataatgacgatagttttnntttgtcattccgtttctccttctatctctcatttggacaacgaagaacaaaaaaaaaattaagcaaaaggcgttcacagagtgttatctggtagttcatacacccaagaagtaatacacattatataatagcatagagttaaagatgtcagagcaagctcaacctcaggcatctgctgatcaacagcaacaccaacataatcaccaccaccatcatcatcatcaccatcataatgaaaatcaatcgcaacagcaagttccgatcgaccccgctgcaaatccagcaaatagaatagggcggtatcaaattctcaagacattaggtgaagggtcatttggtaaagtgaaattggctcaacacttgggcacaggtcaaaaagttgctttgaaaatcattaatcggaaaacattagccaagtctgacatgcagggtcgtgttgaaagagagatttcatatttaagattattgagacacccacatatcattaaattatacgatgtcataaaatccaaagatgaaatcattatggttattgaatttgccggtaaagaattgtttgattatattgttcaaagaggtaaaatgccagaagacgaagccagaagatttttccaacaaattattgctgctgtagagtattgccatcgtcacaaaattgtccatcgtgatttaaagccagaaaacttattgttagacgaccagttgaatgttaaaattgctgattttgggttatccaatatcatgaccgatggtaatttcttaaagacatcttgtggatctcctaattatatgcccgctccggaagttatttctggtaagttgtatgctggtccagaagttgatgtttggtcagcaggggttattttgtatgtcatgttgtgtggtagattaccattcgatgacgagttcatccccgccttatttaaaaagatcagtaatggtgtttacactttgcctaattatttgagtgctggagctaagcatttgttgacaagaatgctcgttgttaacccattgaacagaatcaccatccatgaaattatggaagatgactggtttaaacaagatatgccagattatttgttaccaccagatttatccaaaaacaagaatagcaagattgacgttgatgaagatgttatccgtgcattatcggtgacgatgggatatgaccgtgattgcaaaatcgttaatgtaattgaaaaggcaaacaaacaagttgctgcaggaaactcatcgtctcagcaatcgaaatcaagtaatgagatattagatgcctatttattaatgaaagagaatcatgcattggtgaaagacttgaaaaagagtaaatcagaaaacattgaatcattcttatcccaatctccaccaccaagtccattccctaacagaggatcaacaagctcggctcctggtgtgcagcaatctttaacttatcaaacattagctacagtgcctgacttgtcaacgttaccaaattcgaccattgccatattaccaaccagtttgccttcgatacatcgagcctatatggccgaaactaaacagaatggtgatcctctgcaacaacatgctcctcctccaactaagaagctgaaaacaagatggcattttggaatcagatcaagatcatatcctctagatgtaatgggagaaatttatcgtgccttaaagaatttgggcgcggaatgggccaagcctactgaagaagagttatggacaataagagtaagatggaaatatgacactagtgcacaatttgaatgtggcagtgcaccaaatttgatgaagatgcaaatccaattattccaattggaaccaaataactatttagttagtttcaaatttagtggttgggaactggcacatggaaatgcaggtaccgattctcctcaaagtcacagacaacaagacctagatgaagttgggtcattctctgcttatcctttcttacatttagctactagattaattatggaattagccgtaaatagtcaaagtggataaaataaagaaagtaagtactagcttagattgtatgtcagcagatatgtaatatgtatgataaattgacaacccagtttttggatttcttacaccaaaaataatgtaaaataatgaagcaaagccaacaagtttatcgattttaacgtagtttacgtaaggtatttggaatt

SEQ ID NO: 21 - protein, 620 aa, Candida albicans
MSEQAQPQASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYAGPEVDVWSAGVILYVMLCGRLPFDDEFIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHALVKDLKKSKSENIESFLSQSPPPSPFPNRGSTSSAPGVQQSLTYQTLATVPDLSTLPNSTIAILPTSLPSIHRAYMAETKQNGDPLQQHAPPPTKKLKTRWHFGIRSRSYPLDVMGEIYRALKNLGAEWAKPTEEELWTIRVRWKYDTSAQFECGSAPNLMKMQIQLFQLEPNNYLVSFKFSGWELAHGNAGTDSPQSHRQQDLDEVGSFSAYPFLHLATRLIMELAVNSQSG

SEQ ID NO: 22 - DNA, 3332 bp, Candida tropicalis
  CDS (301)..(2160): GenBank Accession No. AB024535
tctagaatcactaaccatacgacccacacgagaccagtcgtgtggtgaccgtaaatttttctgtcattttttttttcttccttctagctctcaagttttttttgttgaaggtgtgtcgaacgaatttaagggagaacaaaggaaggacaacgaaacccaacacatacccaccaacaaaacagcacgggacaaattatagcacagctattttattatttagatagacttttgttgttttcatctgttttcatctccatacccatagcctcctttacattccattagaattgttcagtcaaaatgtcggagcagaatcaaggacagcccgatcagcagcacagcggtgaccaccaacaccatcatcaccaccaccaccaccaccaccactcgcagcagccagcgcagcctattccaatcgacccaaatgtgaaccctgccaacaggataggtaggtaccagatcatcaagaccttgggtgagggttctttcggtaaggtcaagttggcccagcatgtgggcaccggccagaaggttgctttgaagatcatcaaccgtaagacgttggccaagtcggacatgcagggccgtgtcgagagagagatttcgtatttgagattattgagacacccacatattatcaagttgtatgatgttataaagtcaaaggacgagatcattatggttattgagtttgctggtaaggagttgtttgattatattgttcagagaggtaagatgccggaggatgaagctagaagattcttccaacagattatagcagctgttgagtactgtcatcgtcacaagattgtgcatcgtgatttgaagccagagaacttgttgttggacgatcaattgaatgtcaagattgccgatttcggtttgtcgaatatcatgaccgatggtaacttcttgaagacgagttgtggttctccaaattacgcggctcctgaagtcatttctggtaagttgtatgctggtccggaagttgacgtctggtcatcgggtgttatcttgtatgttatgttgtgtggtagattgccattcgacgacgagttcattcctgctttgttcaagaagatcagtaatggtgtttacacgttgccaaactacttgagtcctggtgccaagcacttgttgacgagaatgcttgttgtgaacccattgaatagaatcacaattcacgagatcatggaagatgaatggttcaagcaagacatgccagattacttgttgccaccagacttgtccaagatcaagaccagcaagattgatatcgacgaagacgttattagtgcgttgtcggtcaccatgggttacgaccgtgatgaaattatttccgtgattgaaaaagccaacagagaagcagctgctggtggagcaactccaacaaaccaatctaaatctaccaacgaagtcttggatgcctatttgttgatgaaggagaaccataccttagttaaagacttgaagaagagcaagtcagagaatatcgaatccttcttgtcgctgtcaccaccgccaagctcatcgttcccaaaccctggttctacaagttctgctcctggcgtacaacaatcgttgacttaccaaacattagcaactgttccagacttgtctactttgcctaactccaccattgctatattaccaaccagtttgccatccattcaccgtgcatatatgatggagaccaaggtgaatgaccctcaacaacagataccggccccacaaccaaccaagaagctgaaaacgagatggcattttggtatcagatccaggtcgtacccactagatgttatgggtgaaatataccgtgcattgaagaatttgggtgctgaatgggccaagcctacagaagaagagttgtggacaataagagtgagatggaagtacgactctacgccgcagttacgagtgtggcaacgcacaaacttgatgaagatgcaaatccaattgttccagttggagccaaacaactacttggttgatttcaagtttgacgggtgggaacaaacaagcgacgagagcaagaacgacgcctctctggattacaagcaacaagacttggacgaagttggttcgttctctgcctacccattcttgcatttggccactagattaattatggagttggcagtgaatagccagagcgggtagttcagaggggggatacttaatgaatgtttatagttagaatgtctatggcatattattgatttatactagcgtgtctatgggtggtgtgtaaaatttccgtgttttcctgtgtagaaagccatcccatatggagtgtattttttgcaggcataggttgttttttgtgcacccactttataattcctgtgttttgattttctgggttaaccctttcctaatcggggcaaattaaatacaacattgtgtaaaattaattctggcagcatttctcgcggcaccaccgccaatttcccttcctgtggccccgaccggtgtgcctgtttctaccgcgagagacaaagagatcacaaagaaactcaaagccaatgccaccagaaccatcaacgaccagaacagaacccacaaaaatcttttcccaatcttcccactaccacttttttcctttctttctaaatcaccaacccgtcctttcctttacaaacaacccattcgcttagtctactagacaattggatacctttcttcactcactctacgttgcggcccattaccaaaaaggaatatcataaaaatagaacaagtcacgtgacacggcatcgatatctgcacccaccttacacttgatagagaacccatctagcttacacattcccttcacggaggttcttgaacaatcccacagacagcaactcacatagccaagagttagcaccatccccaaaagaaaagttcatcggcgctaagtgtaccatactttacaaacgaaaaaagcgagcctcctctttctccttctccttctccttctccaaccaaccacaagtatctgaaattcgaggagagacagctagcatccaaaaagccggactacaaacacagacagggaaaaaaaagtcaagcaacattacgactggattacctgtgcaaccgttaaattaaaaagactttgaggagacataataaccttaatacccccaaacccatcctcctacctagctggactactgtcgaaagagagcaagagagagaatcgacagactaaagactcagagacagcgcaaagttctgaaccagaaaagaaacacacattcacttttgtacacataattacaaccaccaccaccaccacaatgatacccatagacttgacgagatcacatgacgtatccctgcag

SEQ ID NO: 23 - protein, 619 aa, Candida tropicalis
MSEQNQGQPDQQHSGDHQHHHHHHHHHHHSQQPAQPIPIDPNVNPANRIGRYQIIKTLGEGSFGKVKLAQHVGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSSGVILYVMLCGRLPFDDEFIPALFKKISNGVYTLPNYLSPGAKHLLTRMLVVNPLNRITIHEIMEDEWFKQDMPDYLLPPDLSKIKTSKIDIDEDVISALSVTMGYDRDEIISVIEKANREAAAGGATPTNQSKSTNEVLDAYLLMKENHTLVKDLKKSKSENIESFLSLSPPPSSSFPNPGSTSSAPGVQQSLTYQTLATVPDLSTLPNSTIAILPTSLPSIHRAYMMETKVNDPQQQIPAPQPTKKLKTRWHFGIRSRSYPLDVMGEIYRALKNLGAEWAKPTEEELWTIRVRWKYDSTPQLRVWQRTNLMKMQIQLFQLEPNNYLVDFKFDGWEQTSDESKNDASLDYKQQDLDEVGSFSAYPFLHLATRLIMELAVNSQSG

SEQ ID NO: 24 - DNA, 2184 bp, Candida glabrata
  CDS (155)..(1990): GenBank Accession No. L78130
cggaagctaaaaagcttgggatggagaggggggaatggcctttgtcctctctgtgatttgcacaactattgaagaagagtaagttttcaacttagtgtatattactagaagttctttctgttgagttataagtttgcgacatgtgacgggaaaaatggagaacaaggagcatcatcaccaccaccatcaccaccatcaccaccattctaatgggtcctatgtgagcaacaaggtgtcctcgctggctgatggttctcgtgttggtaattaccaaattgtgaagacgcttggagaaggttcctttggtaaagtgaagctggcataccatgtaaccactgggcagaaagtggcattgaagtcaattaacaagaaagtgttggccaagtctgatatgcaaggtcgtattgatcgtgagatatcgtacctgaggttgctgagacacccacatatcatcaaactgtatgatgtcatcaagtctaaggacgaaattatcatggttatcgagtatgcaggcaatgagttgttcgattacattgtgcagaggaataagatgagtgagcaggaggccaggaggttcttccagcagattatcagtgcagtagagtactgccacagacataagattgtacatagagacttgaagccggagaacttgttgttggacgaacacttgaatgtcaagattgccgatttcggtttgtctaatatcatgacagatggtaacttcttgaagacttcatgtggttcaccaaattacgcggcaccagaggttattagtgggaaactgtatgcaggtcctgaagtcgatgtgtggtcttgcggtgtcattttatatgtcatgctttgtcgtcgtttgccgttcgatgatgaaagcattccagtgttgttcaagaacattagcaacggtgtctacactttgccaaagtttttgtcacctggagcttctgatcttattaagagaatgcttattgttaacccattgaacagaataagtatccatgaaataatgcaggatgaatggttcaaagttgatctggcagagtatttagtcccacaggatttgaaacagcaagaacaattcaacaaaaagtcaggaaatgaagaaaatgtggaagagattgacgacgaaatggttgttactctatcgaagaccatgggatatgataaggatgaaatttacgaagccttggaatcctctgaagatactccagcttataacgagataagaaatgcatacattctgattaaggacaacaagtctttgatcaaggacatgaagcaagataataatgtaacacaagaactggatacgttcctttcgcaatctcctccaacattccagcagaatggtgatggtatgaaggcatcagaagatcaaaagaaaaaacacagtgggagaagacttgcttcttcggtaactcagcaaaggacgttccaccaaccgccgtttatggaccaatcaaaggaagaggactccacaatctctattccaacctctttaccacaaatccaccgtgcaaatatgctggcacaaggcttaccggctgcttccaagatatcacctttggtaaccaaaaaatcaaagacaagatggcattttggtatacgatcccgttcctacccattagatgtgatgggtcacatttatattgcattaaagaaccttggtgcagagtgggcaaatccttctgaagaagacctatggactatcagggtgagatggaagtatgattcagatgaatccagacttatcgaagatggtgttaagaaaattccaaacctaatgaaaattgtaattcaattgtttcaaatagaaactaataactacttagttgacttcaagtttgacggttgggagagtacttacggtgactcaactatttcaaccaatatgtctgaggatgagatgagtaccttttcggcatacccattcttgcatttgacaactaaacttatcatggaattggctgtaaacagtcaaggaaactagtgctgtgcattaagcttccaacctcatgatatttaatcattctatttgttttttccagctcctctattgaatgttacaataaaaaatcaaaacgatcaaaatcttggccaagaacgaacagtctctgttatagtgttggagcgttttctcattacccaatcgatatgttgttcttgttacaagaactgttatag

SEQ ID NO: 25 - protein, 611 aa, Candida glabrata
MENKEHHHHHHHHHHHHSNGSYVSNKVSSLADGSRVGNYQIVKTLGEGSFGKVKLAYHVTTGQKVALKSINKKVLAKSDMQGRIDREISYLRLLRHPHIIKLYDVIKSKDEIIMVIEYAGNELFDYIVQRNKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGASDLIKRMLIVNPLNRISIHEIMQDEWFKVDLAEYLVPQDLKQQEQFNKKSGNEENVEEIDDEMVVTLSKTMGYDKDEIYEALESSEDTPAYNEIRNAYILIKDNKSLIKDMKQDNNVTQELDTFLSQSPPTFQQNGDGMKASEDQKKKHSGRRLASSVTQQRTFHQPPFMDQSKEEDSTISIPTSLPQIHRANMLAQGLPAASKISPLVTKKSKTRWHFGIRSRSYPLDVMGHIYIALKNLGAEWANPSEEDLWTIRVRWKYDSDESRLIEDGVKKIPNLMKIVIQLFQIETNNYLVDFKFDGWESTYGDSTISTNMSEDEMSTFSAYPFLHLTTKLIMELAVNSQGN

SEQ ID NO: 26 - DNA, 1740 bp, Yarrowia lipolytica
  CDS (1)..(1740): GenBank Accession No.  CR382130 (region 236133..237872 of chromosome D of strain CLIB122 of Yarrowia lipolytica)
atggcgaccgaacacgtggaacacgccgaaaacgccaagcagtcgccccaaccgtccttctcgggctccgagagcggccgaattggccggtaccaaatcatcaagactctgggagagggctcctttggcaaggtcaagctcgcctaccatctggccacccacgaaaaagtagcgctcaaaatcatcaacagaaagacgctggccaagtcggatatgcagggccgagtcgagcgggaaatctcgtacctgcgactgctcagacacccccacatcatcaagctgtacgacgtgatcaagtccaaggatgaaatcatcatggtgattgaatttgccggcaaggagctctttgactacattgtgcaacgtggaaagatgcccgaagacgaggctaggcgattcttccaacaaatcatctccgcagtcgagtactgccatagacacaagattgtgcacagagacctcaagcccgagaacctgttgctcgacgaaaacctcaacgtcaagattgccgactttggactctccaacattatgaccgatggtaacttcctcaagaccagttgtggctctcccaactatgctgctcccgaggttatcagtggcaagctgtatgctggccccgaggtcgacgtgtggtcctgtggtgtcattctatacgtcatgctgtgcggccgtctcccctttgacgacgaattcatccccaacctcttcaagaagatctccaatggtgtctacaccattcccccctatctgtctgccggcgcaaaacacctgcttcaacagatgctggtggtcaaccccctgaaccgaatcaccgtccagggcatcatggaagacccctggtttaaacagggcattgccgagtaccttgttccacgtgacctgaagcctgatcaggtggaaatcgacgacaaggttgtgggtgctctttcagacaccatgggctacgaccgagaccaggtctacgaggctctcaaggctcctaaatccgacggaaccgaaatccgagatgcctacgacctcatgaaggagaacagacagcagttggagaaggactcgaccgtgttcgacaaggtggacgaatccggcaagcctaagcaccagttctcgcgaaagaacccgccggctctgacgtttgactcacatcacatgcccaccattgtcgaccattctgatcttcgaacccctaacacaaccattgctgttcttccctcctcgctgccagcataccatcgggccaacatgatggcccatggtcccgctaccctgcgtaagctgaatcccatctcatcgcgaaaatcaaagacccgatggcatttcggcattcggtccaagtcgtaccctctcgacgtgatgggtgagctctaccgagctctcaagaacctgggagccgagtgggcaaagccatcagagaacgacctgtggaccatcagggtgcgatggagatacacccctgaaaaggatgagtcggacagcacaactaagccagacagcggactgcttaagatgcagattcaactgtatctgctggagcagaactcgtacttggtggacttcaagtttgacggctgggagtgcgagacggagagcggtgagattaagacccgcgatgtcgcccaggtgtcgaattcaaagtccgccaacgagaccttcacgttttccgcataccccttcttgcatctggccacccggctcattatggagctggccgtgagttctcagaaggagagtgagaagtaa

SEQ ID NO: 27 - protein, 579 aa, Yarrowia lipolytica
MATEHVEHAENAKQSPQPSFSGSESGRIGRYQIIKTLGEGSFGKVKLAYHLATHEKVALKIINRKTLAKSDMQGRVEREISYLRLLRHPHIIKLYDVIKSKDEIIMVIEFAGKELFDYIVQRGKMPEDEARRFFQQIISAVEYCHRHKIVHRDLKPENLLLDENLNVKIADFGLSNIMTDGNFLKTSCGSPNYAAPEVISGKLYAGPEVDVWSCGVILYVMLCGRLPFDDEFIPNLFKKISNGVYTIPPYLSAGAKHLLQQMLVVNPLNRITVQGIMEDPWFKQGIAEYLVPRDLKPDQVEIDDKVVGALSDTMGYDRDQVYEALKAPKSDGTEIRDAYDLMKENRQQLEKDSTVFDKVDESGKPKHQFSRKNPPALTFDSHHMPTIVDHSDLRTPNTTIAVLPSSLPAYHRANMMAHGPATLRKLNPISSRKSKTRWHFGIRSKSYPLDVMGELYRALKNLGAEWAKPSENDLWTIRVRWRYTPEKDESDSTTKPDSGLLKMQIQLYLLEQNSYLVDFKFDGWECETESGEIKTRDVAQVSNSKSANETFTFSAYPFLHLATRLIMELAVSSQKESEK

SEQ ID NO: 28 - DNA, 1116 bp, Yarrowia lipolytica
  misc_feature (1)..(1116): Locus YALI0C03421g within public Y. lipolytica protein database of the "Yeast project Genolevures" (Center for Bioinformatics, LaBRI, Talence Cedex, France)
gatcacccgagcaggtttcccacctgtcagcttctcctgaaggacgtgacgattgagcaggtggtcaatgcttccaacaacaacaacaatactctaactcctctggctgagtcttctgccggtgccacccacacaccaccatcatccgtgcacattgtcaacgagcagaagctggcagtgcgttcgatccgacaattccttcaatctaaatctgcatacgatgttctccctgtgtcgttccggctcattgtgctggacacggcactgctggtgcgaaagtcgctgaccatattgctgcaaaataacattgtcagcgcgcctctgtggaactccaagacgtccaagtttgccggtcttctgactgccgcagactatatcaacgtgatccagtactacttccagaacccggacaagatggaggagattgacaaaatcacgctagatgacttccgtgacgtggagaaggcggtgggcgccaaaccgatcgaaaccatttcgatccaccccatgaagtccatctttgaggcttgcaaaaagatgattgagagcaaagccaagcgaatcccactgatcgatagagacgaggaaacgggccgagaaattgtcgtttccgtgctgacccagtaccgaatcctcaaatttgtggcgctcaactgcaaggagacgcgtggtctgatgatgcctatctgctcgctccccaagctgggtgtcttcaagggactcgccacggcccacatggacacccccgtggtccaggtcatcaagctgctggtggacgcgcgggtgagttcgatccccatcgtcgacacccacaaccgactcatgaacgtgtacgaagccgtggacgtgctggcactgatcaagggcggcatctacaccgatctgacactgtctgtcggagaggcgctcatgcgacggcccgaggactttgagggcgtgtacacatgcactaatcaggaccgtctggataccattatgaacacgatccgacggtcacggctgcatcgactgtatgtggttgacggagacggcaagttggagggcgtggtgaccctgtccgacattctcagatacttgttgtttgacgaggatgtcgagcaggtggaggttaagtag

SEQ ID NO: 29 - DNA, 1126 bp, Yarrowia lipolytica
  CDS (1)..(24)
  Intron (25)..(175)
  CDS (176)..(1123)
atgcaacctcgatcacccgagcaggtttcccacctgtcagcttctcctgaaggacgtgacgattgagcaggtggtcaatgcttccaacaacaacaacaatactctaactcctctggctgagtcttctgccggtgccacccacacaccaccatcatccgtgcacattgtcaacgagcagaagctggcagtgcgttcgatccgacaattccttcaatctaaatctgcatacgatgttctccctgtgtcgttccggctcattgtgctggacacggcactgctggtgcgaaagtcgctgaccatattgctgcaaaataacattgtcagcgcgcctctgtggaactccaagacgtccaagtttgccggtcttctgactgccgcagactatatcaacgtgatccagtactacttccagaacccggacaagatggaggagattgacaaaatcacgctagatgacttccgtgacgtggagaaggcggtgggcgccaaaccgatcgaaaccatttcgatccaccccatgaagtccatctttgaggcttgcaaaaagatgattgagagcaaagccaagcgaatcccactgatcgatagagacgaggaaacgggccgagaaattgtcgtttccgtgctgacccagtaccgaatcctcaaatttgtggcgctcaactgcaaggagacgcgtggtctgatgatgcctatctgctcgctccccaagctgggtgtcttcaagggactcgccacggcccacatggacacccccgtggtccaggtcatcaagctgctggtggacgcgcgggtgagttcgatccccatcgtcgacacccacaaccgactcatgaacgtgtacgaagccgtggacgtgctggcactgatcaagggcggcatctacaccgatctgacactgtctgtcggagaggcgctcatgcgacggcccgaggactttgagggcgtgtacacatgcactaatcaggaccgtctggataccattatgaacacgatccgacggtcacggctgcatcgactgtatgtggttgacggagacggcaagttggagggcgtggtgaccctgtccgacattctcagatacttgttgtttgacgaggatgtcgagcaggtggaggttaagtag

SEQ ID NO: 30 - protein, 324 aa, Yarrowia lipolytica
MQPRSPEQQKLAVRSIRQFLQSKSAYDVLPVSFRLIVLDTALLVRKSLTILLQNNIVSAPLWNSKTSKFAGLLTAADYINVIQYYFQNPDKMEEIDKITLDDFRDVEKAVGAKPIETISIHPMKSIFEACKKMIESKAKRIPLIDRDEETGREIVVSVLTQYRILKFVALNCKETRGLMMPICSLPKLGVFKGLATAHMDTPVVQVIKLLVDARVSSIPIVDTHNRLMNVYEAVDVLALIKGGIYTDLTLSVGEALMRRPEDFEGVYTCTNQDRLDTIMNTIRRSRLHRLYVVDGDGKLEGVVTLSDILRYLLFDEDVEQVEVK

SEQ ID NO: 31 - DNA, 1173 bp, Yarrowia lipolytica
  CDS (1)..(1173): Gal83 homolog; Locus YALI0E13926g within public Y. lipolytica protein database of the "Yeast project Genolevures" (Center for Bioinformatics, LaBRI, Talence Cedex, France)
atgggaaacgcacagagccaggaggaggccaacaacaatggagctgctcggcagcaccgtccagcggacaacaacggccatcacgaccccaagggcaccgccgatccgcagcccatcccccaggagggctccgacaacacacagaaccatgtgagccattcgccagagcaaatgtccgccaactcgtcgcatgtcagcgcaacacccttcaacaacccatttgagcccgcctcgtaccacaaagagtcgcctgctccggaaagcgtccccgtccccgtggcgcccgcaaagagccacccccagcggcccaagatgcgacgaaagtcaactttgctgctggatgaagacgaacccgtgggagagaacgacgacgatatccccttcgacaaactcaacatcacccatcccacatccaacgagcccaagccgctgtcacgggtggactccggcgaagagatcgaactcacctcccctcaggtgaccgaaggaaagatccccctcgaaatcaaatggactcagggaggctccaaggtctacgttactggaaccttcactggttggagaaagatggtggctctgaccccggaccccaacaagaagggcgtcttctctaccacccttcatcttcctcctggaacccacagactgcgatttgtcgtagacaatgagctgcgatgctcagactacctccccacagccacagactccatgggtaatcttctcaactacgtggaggtgggtctatcggacaccgaggaacgggccgaccagaaggatctgcatcccatttctcgagcaggcatcatccccagtaacgacgatctgggaggaggctacgagcggttcactgaagaagatctgcccaaggaggagtacgagttcacaccggaaatcccggctctgttcaccgacacagaagtgatggagcagtacatctccaaagagttgcccacgcctccccaactgcctccccatctggactcggtcattctcaacacaaactccaccgaaaaggaagacaactcggtgctgcccatccccaaccacgtcattctcaaccatctggccaccacgtccatcaaacataacgttctggccgtggcctcggtctcccggtactctcgtaagtacgtgacccaggttctctacgctcctttgcctcttcaggcataa

SEQ ID NO: 32 - protein, 390 aa, Yarrowia lipolytica
MGNAQSQEEANNNGAARQHRPADNNGHHDPKGTADPQPIPQEGSDNTQNHVSHSPEQMSANSSHVSATPFNNPFEPASYHKESPAPESVPVPVAPAKSHPQRPKMRRKSTLLLDEDEPVGENDDDIPFDKLNITHPTSNEPKPLSRVDSGEEIELTSPQVTEGKIPLEIKWTQGGSKVYVTGTFTGWRKMVALTPDPNKKGVFSTTLHLPPGTHRLRFVVDNELRCSDYLPTATDSMGNLLNYVEVGLSDTEERADQKDLHPISRAGIIPSNDDLGGGYERFTEEDLPKEEYEFTPEIPALFTDTEVMEQYISKELPTPPQLPPHLDSVILNTNSTEKEDNSVLPIPNHVILNHLATTSIKHNVLAVASVSRYSRKYVTQVLYAPLPLQA

SEQ ID NO: 33 - DNA, 1503 bp, Yarrowia lipolytica
  CDS (1)..(1503): Sip2 homolog; Locus YALI0C00429g within public Y. lipolytica protein database of the "Yeast project Genolevures" (Center for Bioinformatics, LaBRI, Talence Cedex, France)
atgggaaacgcagaatccaaaccccggcgcaagcagcggtccacgggcagcgaaagctcccaaaccagcacccagtcgcttccggcacagactcaaacacaaacacattccgccgccatcaaagcctcctctcgccccaaacgaacacagagacccgcctctgcgcaccccgcagtacccatccccacaaagtcttttcaggagaaatcagctctcatgaaccgacttgttaccccggcccagccctgctctgctcgggttacttacatcaagcctgtcaccgtgtctcctgacgacgaaaaggacgccgatattggccccaccgcaaaagctccggtggttgttgcgacagaaatcccttccattctgacgccagaagactcgcccaaatacctggagccctctgaggcagcgcccttcggtaagctccacgtgggagcccaagtcgccgagggtctccagggaaaccgacgagactcagataatcgcaacattgtcaactccaagatccagctgcgagatgactcgcccgcagaagacgacgaagacgactcagaagactactactacaaaaacaacctcacctacggcctcaaacagctcaagctaggcaccgatgtcgccaacatgaacattgaggtggtgggacaagacgccgtctcaaagccgctgtcgcgggtcgactcgggcgatgaggttgagctccggtaccagggccatgatgatgtgagcagtagcagtggacatggacctcggcctggtgctgtgagaaccaaaatctgctacaagcaaggaggcaacaaggcatacatcacaggcaccttcaccggctggagaaagatgctgcctatggatcgccagtcagacggcaccttttccgtcaccctggatctcccagaaggcactcatcggttccggtttgtgattgacggagagctcaagtgtgctgacgacattggtacggccacagactcgtctggcttcctcgtcaactatctggatgtcggtaacgatgactctgacaatgtccctgcatcgttctcagaagagaacattcctctttgccgagagggcgacctcaagaagccccaaaccacgtctgccactcagccccaaaccacacaccatgcatcatctaaccaccacagccatggcgacgacggaatcacgcaatacgaggacgagactcccatccccccaccactggagtacaccaacgagatccccagtatgttcctgacgctggacgtggccgaactcgacattcccgagagccaggcagtgcctccacatctacctcctcatcttgatacggtgattctcaacaccaactccaacgagaaggatgacagctctgtgctacctgcccccaaccatgttgttttgaaccatttggccacctcatctatcaagcacaatgttcttgctgtagcctccgtcaaccgctacggcaagaagtttgtcacccagattctgcatgcgcctatgccttctctgaactaa

SEQ ID NO: 34 - protein, 500 aa, Yarrowia lipolytica
MGNAESKPRRKQRSTGSESSQTSTQSLPAQTQTQTHSAAIKASSRPKRTQRPASAHPAVPIPTKSFQEKSALMNRLVTPAQPCSARVTYIKPVTVSPDDEKDADIGPTAKAPVVVATEIPSILTPEDSPKYLEPSEAAPFGKLHVGAQVAEGLQGNRRDSDNRNIVNSKIQLRDDSPAEDDEDDSEDYYYKNNLTYGLKQLKLGTDVANMNIEVVGQDAVSKPLSRVDSGDEVELRYQGHDDVSSSSGHGPRPGAVRTKICYKQGGNKAYITGTFTGWRKMLPMDRQSDGTFSVTLDLPEGTHRFRFVIDGELKCADDIGTATDSSGFLVNYLDVGNDDSDNVPASFSEENIPLCREGDLKKPQTTSATQPQTTHHASSNHHSHGDDGITQYEDETPIPPPLEYTNEIPSMFLTLDVAELDIPESQAVPPHLPPHLDTVILNTNSNEKDDSSVLPAPNHVVLNHLATSSIKHNVLAVASVNRYGKKFVTQILHAPMPSLN

SEQ ID NO: 35 - DNA, 2724 bp, Yarrowia lipolytica
  CDS (1)..(2724): Sak1 upstream kinase of SNF1; Locus YALI0D08822g within public Y. lipolytica protein database of the "Yeast project Genolevures" (Center for Bioinformatics, LaBRI, Talence Cedex, France)
atgtcttccacaacccctgggtcgggctctccgtcgcgcacctccacgcccgtgctcacccacaccagcagccatacgtcggtcaaggaaacgtcgtatgtcaacctcgactacgaccccgtctccggacgcaccacgctcaacacgtacgaagtcatcaaggagctgggccgaggccaacacggcaaggtcaagctaggacgagacctgaccacgggcgagtacgtggccatcaaggtcgtggatcgcctgggaaaacccaagctcggcaagtacgcccagctgcgcaaagatccgtcggacagaaacgtgcacgaagaggctgtcaaacgcgaaattgccattctcaaaaaatgcgaacacccacacattgtgcgactgctggaggtaatggatgacgtcaagtcgcgcaaaatcttcatggtgttggaatactgcgaaggaggcgaactggtgtggcagaacgacgacggtacgccctccatgaccatggacgaagccagacaggtgttcagagacgtgctcttaggtctggagtacctgcactttcagggaatcattcacagagatatcaagcccgcaaatctgctcctgtgccacaaacaggtcaagatttcggactttggcgtgtctttcacctctgccggagataccacagatgagattgagctggccaaaacagcaggaacccctgccttctttgcaccggagctgtgccaaaacaaccccggtaagggcaactgcgtcaccaacaaaattgacatttgggccctgggcgtcactctgtattgtctgctgtttggaaaagtgcccttctctgccgactctgaatacgaactattcgaggtcatttgcagagaccaagtcaccttccccgatacagacgacgacgccagtggtagcacaaagacagatagcgcccccggtagcgcaatcagcaccactgcgccccagtctctttccgtgcaaacatcctctttctctcccacttcggagtcttcgcagttctcccagagctccgagagcgaacgaagcatcacctcccccacctcccaggcatcttctttttccacagcatctcttttgacatcatcccgccacggctccagggccaatctttctggagccacctctcgagcgactagcagagacgccacaacagcgcactcgaatgccacagccacacgagagcctcgagatctgtcgcaagcgcgaatgtcgtcacgatcgtcactatcacggtactttcaccgggagagacacgactcgtcgtcttctcagttgagctctcctcagcaacatcatctcagtaagcccgaactcccacctattcaggcttcggccaatacggacatgcagcttgcgcacgatctcattctcaagctgctcgaaaaggaccctaacaaacgcatcacaatccaggaaatcaaggatcacccatggacgcaaatgaacatgtgcaacgaggaggccagggagttcaacgaggcctccaacgacgagcagcgtatcgaaatcaccaacgaggacctgcagaccgctgtcagcggcattggctcgaaaatcagaaagggcctcaccaagctgggcacatctgcgttggcctttgctggaataaagcgccggggaagcggagcctctaccacagcttcaactacccgaggctccactcctgtgggctctcctgcatctttccagcccggaacctcggcggcaacctcggcgtctacgtcatgtattccagactctcttcccgagcctttgccctcttctgttatgtcgaaccaaagtgctccccccatgtctgcatcgactacaaatgtgcccgaccacaacccacccccgcagatggttatcaatcctcccgtggttggcttttctgctgatgacgatgacgacgacttggaaacacccaccatcaagggcatgcccaaatttggagacactgtcatcactgagggtcttcttaagtcgtcactagcgtccgagatctttgatcttcagaacggaccctgggcccagtcgtccgacattgcgtcccctcgtttccctcccattctcagttctagacaactgcgtcaagaaccacaggcatatacatctctggaccctggccgagcatcgtccgaccgtgcctcgccttcgtacgagaaaaagtcgtttgatgctccccagcggccctcctacgaccgacaaaactccggtggttctcgtttggaccccggaagccggtcgttccttcccctgacctcagccgagcgtcctcctcacatcattgagcgtccctctgtctcgcgaggtctctccatcgactccaacgactcctccatctcttcgtcttcttctacgggcgaactggagctcgttgtgggccggaagggacccggcgagttctcttcttccatcacttctggaggaggagacacgtccgacatgcgacgtcctcgtctcgtgtcggactcccagattgatcgcacctttgaacggtctcataacgaagctgtcatgcccaacattgaggacattgaaatggaagatccctttggtggcgagccagacaacatgtccaccatccactctgcgcaccccagcatttctagcgaagcccggagcttggcagcaggaagcacaaccagcgcaggcagcgatggaggcggacgaaaacggtcgtcgaccattacaaacggaatcttgcagagacaacgacccacgtttgatttatag

SEQ ID NO: 36 - protein, 907 aa, Yarrowia lipolytica
MSSTTPGSGSPSRTSTPVLTHTSSHTSVKETSYVNLDYDPVSGRTTLNTYEVIKELGRGQHGKVKLGRDLTTGEYVAIKVVDRLGKPKLGKYAQLRKDPSDRNVHEEAVKREIAILKKCEHPHIVRLLEVMDDVKSRKIFMVLEYCEGGELVWQNDDGTPSMTMDEARQVFRDVLLGLEYLHFQGIIHRDIKPANLLLCHKQVKISDFGVSFTSAGDTTDEIELAKTAGTPAFFAPELCQNNPGKGNCVTNKIDIWALGVTLYCLLFGKVPFSADSEYELFEVICRDQVTFPDTDDDASGSTKTDSAPGSAISTTAPQSLSVQTSSFSPTSESSQFSQSSESERSITSPTSQASSFSTASLLTSSRHGSRANLSGATSRATSRDATTAHSNATATREPRDLSQARMSSRSSLSRYFHRERHDSSSSQLSSPQQHHLSKPELPPIQASANTDMQLAHDLILKLLEKDPNKRITIQEIKDHPWTQMNMCNEEAREFNEASNDEQRIEITNEDLQTAVSGIGSKIRKGLTKLGTSALAFAGIKRRGSGASTTASTTRGSTPVGSPASFQPGTSAATSASTSCIPDSLPEPLPSSVMSNQSAPPMSASTTNVPDHNPPPQMVINPPVVGFSADDDDDDLETPTIKGMPKFGDTVITEGLLKSSLASEIFDLQNGPWAQSSDIASPRFPPILSSRQLRQEPQAYTSLDPGRASSDRASPSYEKKSFDAPQRPSYDRQNSGGSRLDPGSRSFLPLTSAERPPHIIERPSVSRGLSIDSNDSSISSSSSTGELELVVGRKGPGEFSSSITSGGGDTSDMRRPRLVSDSQIDRTFERSHNEAVMPNIEDIEMEDPFGGEPDNMSTIHSAHPSISSEARSLAAGSTTSAGSDGGGRKRSSTITNGILQRQRPTFDL

SEQ ID NO: 37 - DNA, 1962 bp, Yarrowia lipolytica
  CDS (1)..(1962): Elm1 upstream kinase of SNF1; Locus YALI0B17556g within ptblic Y. lipolytica protein database of the "Yeast project Genolevtres" (Center for Bioinformatics, LaBRI, Talence Cedex, France)
atgacaaccaccgtgcaaaccaccaccaacaccctcatcatggaccggtgttgcacgtcggccgcaaccgtgtcggtgccctcgatagtcgtcgacaagggccacagacgagtttcctctttggaggtcgcaaacggtgcaagtgcagccaccataacaaaaacatcagaaaataccgacaaacagacacagaaaccgccgtcgccaacctcaggtaactcgctggcgccaccaaccaaacgcatggcccgtcccccgcttaagcgggtccattcgtccccctcggacgtggtcagatcaccctcgagacaccacatgcgtcttatttccaccacccccaaactcatcaaggagaccctggacgcgtcctaccatgaagatgagaccggaaagacgctcaacaactacctgattcaggaagaaatcggagctggcgcgtttggaacggtatacagagtggtcgatactacgacccaggagaagttcgccatgaagtcatactccaaggcccgtctacgaaaaatgaaccaaacggaatggatgcagctgcgtcgaaaactcatgcgaaccaaagaccccgtggagcagaacaaaatcaaggaagctctggagtccttcacttccaaccccctcaacctcattcgacgagaaatcgccattctcaaaaaactcgaccaccccaacattgtcaacctcgtcgaagtgcttgacgacccccacggagactctctctacatggtgatggactggtgccacggcgttctcatgcattcagaggaaacggatggaagcaaaaaccccaaatatacggaggagcagtgtcgactgtacttccgagacatgattctgggtatcgaatttctgcactcgcaaggagtcattcatcgggacattaaggctgacaacatgctgctgagtgaagacgacattctgaagattgcggattttggagtctcagaaatgtttgagagtgaaaacgatacagttctaaggaaggccggtagcccatcgtacatggctcccgaactcgctctcatcacctctcctcattgtctcgagcgagcatcccaggtaggagttaccttgggctccgcagtgagtggccgtgccgcagacatttggtcaatgggcgtgactctgtacttcatgctctacggaaaacttccctttgcatccgagtccatttctgacctctgtgagcaaatcatcttcaacgaagcccctctacccgagggaacttctgaggagcttgttgacttgttccagggtctcttggccaagaacccggccgagagaatgaccatggccgagcttcgagagcacgagtgggtcaacacatttggagatgaccctctcgttgaaaaagaagagaatattggagacggaattcctgctgtgaccaagcaggatctggcagaggcgtttgagcgaattgcggccgacagcgcaaacgagggcgtggaccattcatccgctttctcaaagctcaagcgtatctacggatggagaggaacaggcgaggatgacgacgtcctttcatcattctccacctctacagctgatactccatcagagcccaacgtgactgttcctcagagcatggcatcttcgttggagtcgtctctgaagaagacacgcaacctcccttcgtccatgaagactactacggacgagaagtttgccctccacaaactcaacatggcgctcgatgaaattgtgcaggaacaacggaaacgagacgtcaagaaaatcgaaggtcctccaccccaactcaagatcaaggatcaagaagagcccaagattgcttccatgagcagccacatcactgccgagcccgagagtgataccagtgagaagttggagagacgaccctctcgaactagagtcagaaagattttgggtctcgaggcaatgactgccgttcgatcgagatcgctagatactgacgaccgcatttgttag

SEQ ID NO: 38 - protein, 653 aa, Yarrowia lipolytica
MTTTVQTTTNTLIMDRCCTSAATVSVPSIVVDKGHRRVSSLEVANGASAATITKTSENTDKQTQKPPSPTSGNSLAPPTKRMARPPLKRVHSSPSDVVRSPSRHHMRLISTTPKLIKETLDASYHEDETGKTLNNYLIQEEIGAGAFGTVYRVVDTTTQEKFAMKSYSKARLRKMNQTEWMQLRRKLMRTKDPVEQNKIKEALESFTSNPLNLIRREIAILKKLDHPNIVNLVEVLDDPHGDSLYMVMDWCHGVLMHSEETDGSKNPKYTEEQCRLYFRDMILGIEFLHSQGVIHRDIKADNMLLSEDDILKIADFGVSEMFESENDTVLRKAGSPSYMAPELALITSPHCLERASQVGVTLGSAVSGRAADIWSMGVTLYFMLYGKLPFASESISDLCEQIIFNEAPLPEGTSEELVDLFQGLLAKNPAERMTMAELREHEWVNTFGDDPLVEKEENIGDGIPAVTKQDLAEAFERIAADSANEGVDHSSAFSKLKRIYGWRGTGEDDDVLSSFSTSTADTPSEPNVTVPQSMASSLESSLKKTRNLPSSMKTTTDEKFALHKLNMALDEIVQEQRKRDVKKIEGPPPQLKIKDQEEPKIASMSSHITAEPESDTSEKLERRPSRTRVRKILGLEAMTAVRSRSLDTDDRIC

SEQ ID NO: 39 - DNA, 6731 bp, Artificial Sequence
  Plasmid pYRH10
taagtaagcacttgtagagcacactagggatttagaggggattatggcacgtacaatatagataattaagcagtagctgagtcagttgaatgatcagaggtgtaacatgagtgtggatggattgtgtagagtcgttgtttaaaataatgagttaagaataattatacgactacaggatacgatgtacttgtattgtatcgatacagtacatacagtacatacgtgtaacatactcctaaactgttgcatcacctacaactccaactagtcggtcataattcattaatacgtttccctggtgtagtctaggccaaacactccttggtgaacttcttgagaaagattcgctctctagactccttgaattctctaggctggatttcggcccaaaaagaacccacaaacggcgcaatactcttcttgtagccggaatagttgtctcgaatgacaatatccgggttggcagaccgctgctgatgctccttgacgatgatactctcaaagtggtccacggtagacatgacaataagagccgacgaggttttgctcttgtagttggcgatgagcgttttaagtgccccagagttctccaccaccttgtggatcagctgatgcttttgttcctcgctgagtccttccgaggccagggggatagccaagcaggtgagaatagcgcctgtgtctcgtttagaagaggtgctgtttgtatcatccgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccgtgatcaaagcatgagatactgtcaaggcaagcaagccttacaatatctgttggcttagttaaatcttttttgagatgtaataattggggaacctctgttagatgaacagttgcggcttactcatcttagacatggtccagtttaggcgtaattaattatcagttttaatgcgcctctacgtaataagcgttgccacaagttacagtagagatgataccattgctacaggaccgtatagcgtatataatgacgaggctaattgatgatgatcgacagcgaagacatatctacgtcaatctgacgcttcattttgtgcttcttgttcggatttgtgtttctcccagtgcacccagttttttgctgaccattttttgcttaccagtttttgctcgcgcgttttctcgattgaactctgctgcgagggtggtgtaagacacactccctgtagaacatgcatttcgaggtgtgacatttccatctctgttaaatcaaacgagtgacacaaacggaataaatctacatatacgtcgaaccctcttcttctcttctctctcttccttaatagacaccctcgctatcgactctgctcctccttatcacaccatcaaagtttagggtgtgtcccaacaccacctccacaccacactctattatcaccacctccacgactacataccactccttccaccacctccgtacgttgtgtggaagcttgtgagcggataacaatttcacacaggaaacagctatgaccatgattacgccaagctcgaaattaaccctcactaaagggaacaaaagctggagctccaccgcggacacaatatctggtcaaatttcagtttcgttacatttaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatacgctctcatcaagaatacttcttgagaaccgtggagaccggggttcgattccccgtatcggagtgtttattttttgctcaaccataccctggggtgtgttctgtggagcattctcacttttggtaaacgacattgcttcaagtgcagcggaatcaaaaagtataaagtgggcagcgagtatacctgtacagactgtaggcgataactcaatccaattaccccccacaacatgactggccaaactgatctcaagactttattgaaatcagcaacaccgattctcaatgaaggcacatacttcttctgcaacattcacttgacgcctaaagttggtgagaaatggaccgacaagacatattctgctatccacggactgttgcctgtgtcggtggctacaatacgtgagtcagaagggctgacggtggtggttcccaaggaaaaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagaattcaagatactatcaagacatgtgtcgcaacttaat

SEQ ID NO: 40 - DNA, 7966 bp, Artificial Sequence
  Plasmid pYPS161
aaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgttctggttggctcggatgatttctgcggccccagcgtaaggcaggcgttccgtccggatcggtttgggtcggatcggctttttgattgtcgtattgtcgctcatgttggacctggtgtgtagttgtagtgtcagatcagattcaccagcgaatgcatgtgaacttccccacattttgagccgaggcagatttgggttgcttagtaagcagacgtggcgttgcaagtagatgtggcaaatggggacgaagattccgaggggatatcatagttccaaggggatgtcatcatttgccagctttcgccgccacttttgacgagtttttgtgggtcaaataagtttagttgaacttttcaaatttcagttggcattttgttaatagaaagggtgccggtgctggggggttcattcctcgggttgcagatatcctatctgtcttaggggtatctctttcaatcgacaagatgtagttgggtaacaattatttattaatattctctccatccagtacagtactaacatcttgacatctcagcacaagtgcatcttcccaagtgtttgttggagaggttgttgggtattacttaggaaacagaacacagtacgtggagatcttggatacatcgtacatggaggttatccataaaaaagaccctccaggactagttacaatgccgttagatgaggaaatccacaaccctgattcactatgaacatattatcttcccccaaacttgcgatatatggcccttgatgatagccttgattttacccttgatggtacctccacgaccaaccgatctgctgtttgaagagatattttcaaatttgaagtgctcagatctactaaacatgagtccagtaattctttccgtctttccgatttccgatattcccttttttagcccgacttttcactgctcccatgtcaaacgattaggacttgggagacaatcccactgtcaaaatcaccccgatattctctgtaaaacaagtacttcttccacgtgatcttcaaatacctcttccacgtgaccttcaaatacctcttcaagtacctcttccacgcgaccttcaaagtcccttcaaatacccttctcaattctccccttctcctccatagtccttctctctgactaagcttgagaatacatgacgctaagacgaaaacacactagagaccctgagagcctgaacatgcatccactctgcagttgcgcacgtgcctacagcaactatcgggtccagtgctggatctgacactgcgtctccctatgaagaaactgataaacagatctgcactcataacaatgatctgagcgatgaaaacgtgacctccacagccacaagtcataatcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcaactattagtgaggcttcgggagtggttgtctcggttgtctcattcagactcgttgtgttgtatctatatctatataaacactcttgtccctcaatcccactgccatcttttgctaaacttgccgccaatatgaaactcatctccctcatcaccgtcgctaccaccgctctggcggctgtcggagacaagtacaagctgacctataccagatcagacgcccaatcggtcgaatctctgcccgtcacctaccaagatgacctgatcaccgcctccaccgacggcgaacccatcaccatcaccgagggcgagggcaacaccttctctgttaacgacatgcccatcgcctatctggagctgcaggctttgttctggaccggcgactacggctacaagctccagggctcggtctttgacattgccgccgatggaacctttgagctgagagacggccccaaggagtactactattgcactcctcaccctgagcgaaacgtcatctacgtcatcaacagccccgactactccaagtgtcggttcaagcgtaccatcaagttccacgctgaaaagatctaagtggtaatcgaccgactaaccatttttagctgacaaacacttgctaactcctataacgaatgaatgactaacttggcatattgttaccaagtattacttgggatatagttgagtgtaaccattgctaagaatccaaactggagcttctaaaggtctgggagtcgccgtatgtgttcatatcgaaatcaaagaaatcataatcgcaacagaattcaaaatcaagcagattaatatccattattgtactcggatcgtgacatatctgatatgatctcggatatgatctctgactgtttactgggagatttgttgaagatttgttgaggttatctgaaaagtagacaatagagacaaaatgacgatatcaagaactgaatcgggccgaaatactcggtatcattcccttcagcagtaactgtattgctctatcaatgcgacgagatacctccacaattaatactgtatacgctctaccactcatatctccaatgctaaaatatattcatgcccaggacctctgtgcactgctatgcagcacagtgttgtcgattgaattggtcgtgtctggtccctgatgctctgtgtctcgctgactagtccttccatccagacctcgtcattatctgataggcaacaagttctgctctctcacaccctgccgacacaagggacactcgggcttctctctcacccattcggaaatacagtccttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgttt

SEQ ID NO: 41 - DNA, 702 bp, Yarrowia lipolytica
cgcgccgtgatcaaagcatgagatactgtcaaggcaagcaagccttacaatatctgttggcttagttaaatcttttttgagatgtaataattggggaacctctgttagatgaacagttgcggcttactcatcttagacatggtccagtttaggcgtaattaattatcagttttaatgcgcctctacgtaataagcgttgccacaagttacagtagagatgataccattgctacaggaccgtatagcgtatataatgacgaggctaattgatgatgatcgacagcgaagacatatctacgtcaatctgacgcttcattttgtgcttcttgttcggatttgtgtttctcccagtgcacccagttttttgctgaccattttttgcttaccagtttttgctcgcgcgttttctcgattgaactctgctgcgagggtggtgtaagacacactccctgtagaacatgcatttcgaggtgtgacatttccatctctgttaaatcaaacgagtgacacaaacggaataaatctacatatacgtcgaaccctcttcttctcttctctctcttccttaatagacaccctcgctatcgactctgctcctccttatcacaccatcaaagtttagggtgtgtcccaacaccacctccacaccacactctattatcaccacctccacgactacataccactccttccaccacctcc

SEQ ID NO: 42 - DNA, 719 bp, Yarrowia lipolytica
taagtaagcacttgtagagcacactagggatttagaggggattatggcacgtacaatatagataattaagcagtagctgagtcagttgaatgatcagaggtgtaacatgagtgtggatggattgtgtagagtcgttgtttaaaataatgagttaagaataattatacgactacaggatacgatgtacttgtattgtatcgatacagtacatacagtacatacgtgtaacatactcctaaactgttgcatcacctacaactccaactagtcggtcataattcattaatacgtttccctggtgtagtctaggccaaacactccttggtgaacttcttgagaaagattcgctctctagactccttgaattctctaggctggatttcggcccaaaaagaacccacaaacggcgcaatactcttcttgtagccggaatagttgtctcgaatgacaatatccgggttggcagaccgctgctgatgctccttgacgatgatactctcaaagtggtccacggtagacatgacaataagagccgacgaggttttgctcttgtagttggcgatgagcgttttaagtgccccagagttctccaccaccttgtggatcagctgatgcttttgttcctcgctgagtccttccgaggccagggggatagccaagcaggtgagaatagcgcctgtgtctcgtttagaagaggtgctgtttgtatcatccgcatg

SEQ ID NO: 43 - DNA, 41 bp, Artificial Sequence
  Primer SNF1Fii
gatcaaacatgtcgaccgaacacgtggaacacgccgaaaac

SEQ ID NO: 44 - DNA, 45 bp, Artificial Sequence
  Primer SNF1Rii
gatcaagcggccgcttacttctcactctccttctgagaactcacg

SEQ ID NO: 45 - DNA, 34 bp, Artificial Sequence
  Primer 3UTR-URA3
gagagaattcaagatactatcaagacatgtgtcg

SEQ ID NO: 46 - DNA, 27 bp, Artificial Sequence
  Primer 3R-SNF1
taccactggaatgagctgtggagcacg

SEQ ID NO: 47 - DNA, 20 bp, Artificial Sequence
  Primer ef-324F
cgactgtgccatcctcatca

SEQ ID NO: 48 - DNA, 21 bp, Artificial Sequence
  Primer ef-392R
tgaccgtccttggagatacca

SEQ ID NO: 49 - DNA, 21 bp, Artificial Sequence
  Primer SNF-734F
acaccattcccccctatctgt

SEQ ID NO: 50 - DNA, 21 bp, Artificial Sequence
  Primer SNF-796R
tgaccaccagcatctgttgaa

SEQ ID NO: 51 - DNA, 21 bp, Artificial Sequence
  Nucleotide portion of primer ef-345T
tgctggtggtgttggtgagtt

SEQ ID NO: 52 - DNA, 19 bp, Artificial Sequence
  Nucleotide portion of primer SNF-756T
tgccggcgcaaaacacctg

SEQ ID NO: 53 - DNA, 6599 bp, Artificial Sequence
  Plasmid pYRH18
taagtaagcacttgtagagcacactagggatttagaggggattatggcacgtacaatatagataattaagcagtagctgagtcagttgaatgatcagaggtgtaacatgagtgtggatggattgtgtagagtcgttgtttaaaataatgagttaagaataattatacgactacaggatacgatgtacttgtattgtatcgatacagtacatacagtacatacgtgtaacatactcctaaactgttgcatcacctacaactccaactagtcggtcataattcattaatacgtttccctggtgtagtctaggccaaacactccttggtgaacttcttgagaaagattcgctctctagactccttgaattctctaggctggatttcggcccaaaaagaacccacaaacggcgcaatactcttcttgtagccggaatagttgtctcgaatgacaatatccgggttggcagaccgctgctgatgctccttgacgatgatactctcaaagtggtccacggtagacatgacaataagagccgacgaggttttgctcttgtagttggcgatgagcgttttaagtgccccagagttctccaccaccttgtggatcagctgatgcttttgttcctcgctgagtccttccgaggccagggggatagccaagcaggtgagaatagcgcctgtgtctcgtttagaagaggtgctgtttgtatcatccgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccgtacatgcagaactatttgtattctcctcagacaagatcaccaaagtaatcgtcaccatgtccttcagaggagttccagtatcatctgcagaggcaaaacagcgccaagagcgagatctcgccaagttgcgcgtgccgaaaatctacagagaggcggtggacatgaccaaggtgaaccggccgatcatcaaccggtggatcactacgaagctgaatgagctgctgccagacgacgacattatcactgattacaccctggaactgttgggtggagacaagccagatattcgggagatccagctgaatctgaacgggtttctggaggagaacacagccaagttctgcaaggagctgtgggagctgctggtggctgcccagaaagacaaggacggcattccgccgcagttgattgccatcaagaaggagcagatggagcaggagcgggtgaagcgggaaatcaagattgagagttggagtggtgggggcggtggtggaagagacagaggtgatagaagggaaagaaacgacagaagagacgcaaaaggaagaaacagaagagatggagataggaggaatggcgatcgaagagacagagacagagatagagatagagacgacaggtcaagtcgttcaagtcggtacaaccgatcaagatcaagatctccgactgtcaaaaaggaaacagatgaatatggccgggaccggaaggactaactgcattatatataaatatagattcttgattagtgatcaaagcatgagatactgtcaaggcaagcaagccttacaatatctgttggcttagttaaatcttttttgagatgtaataattggggaacctctgttagatgaacagttgcggcttactcatcttagacatggtccagtttaggcgtaattaattatcagttttaatgcgcctctacgtaataagcgttgccacaagttacagtagagatgataccattgctacaggaccgtatagcgtatataatgacgaggctaattgatgatgatcgacagcgaagacatatctacgtcaatctgacgcttcattttgtgcttcttgttcggatttgtgtttctcccagtgcacccagttttttgctgaccattttttgcttaccagtttttgctcgcgcgttttctcgattgaactctgctgcgagggtggtgtaagacacactccctgtagaacatgcatttcgaggtgtgacatttccatctctgttaaatcaaacgagtgacacaaacggaataaatctacatatacgtcgaaccctcttcttctcttctctctcttccttaatagacaccctcgctatcgactctgctcctccttatcacaccatcaaagtttagggtgtgtcccaacaccacctccacaccacactctattatcaccacctccacgactacataccactccttccaccacctccgtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattccggccaaagttaat

SEQ ID NO: 54 - DNA, 1448 bp, Yarrowia lipolytica
cgcgccgtacatgcagaactatttgtattctcctcagacaagatcaccaaagtaatcgtcaccatgtccttcagaggagttccagtatcatctgcagaggcaaaacagcgccaagagcgagatctcgccaagttgcgcgtgccgaaaatctacagagaggcggtggacatgaccaaggtgaaccggccgatcatcaaccggtggatcactacgaagctgaatgagctgctgccagacgacgacattatcactgattacaccctggaactgttgggtggagacaagccagatattcgggagatccagctgaatctgaacgggtttctggaggagaacacagccaagttctgcaaggagctgtgggagctgctggtggctgcccagaaagacaaggacggcattccgccgcagttgattgccatcaagaaggagcagatggagcaggagcgggtgaagcgggaaatcaagattgagagttggagtggtgggggcggtggtggaagagacagaggtgatagaagggaaagaaacgacagaagagacgcaaaaggaagaaacagaagagatggagataggaggaatggcgatcgaagagacagagacagagatagagatagagacgacaggtcaagtcgttcaagtcggtacaaccgatcaagatcaagatctccgactgtcaaaaaggaaacagatgaatatggccgggaccggaaggactaactgcattatatataaatatagattcttgattagtgatcaaagcatgagatactgtcaaggcaagcaagccttacaatatctgttggcttagttaaatcttttttgagatgtaataattggggaacctctgttagatgaacagttgcggcttactcatcttagacatggtccagtttaggcgtaattaattatcagttttaatgcgcctctacgtaataagcgttgccacaagttacagtagagatgataccattgctacaggaccgtatagcgtatataatgacgaggctaattgatgatgatcgacagcgaagacatatctacgtcaatctgacgcttcattttgtgcttcttgttcggatttgtgtttctcccagtgcacccagttttttgctgaccattttttgcttaccagtttttgctcgcgcgttttctcgattgaactctgctgcgagggtggtgtaagacacactccctgtagaacatgcatttcgaggtgtgacatttccatctctgttaaatcaaacgagtgacacaaacggaataaatctacatatacgtcgaaccctcttcttctcttctctctcttccttaatagacaccctcgctatcgactctgctcctccttatcacaccatcaaagtttagggtgtgtcccaacaccacctccacaccacactctattatcaccacctccacgactacataccactccttccaccacctcc

SEQ ID NO: 55 - protein, 312 aa, Saccharomyces cerevisiae
  MISC_FEATURE (1)..(312): GenBank Accession No. NP_011059; Glc7p
MDSQPVDVDNIIDRLLEVRGSKPGQQVDLEENEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIIDEKIFCMHGGLSPDLNSMEQIRRVMRPTDIPDVGLLCDLLWSDPDKDIVGWSENDRGVSFTFGPDVVNRFLQKQDMELICRAHQVVEDGYEFFSKRQLVTLFSAPNYCGEFDNAGAMMSVDESLLCSFQILKPAQKSLPRQAGGRKKK

SEQ ID NO: 56 - protein, 1014 aa, Saccharomyces cerevisiae
  MISC_FEATURE (1)..(1014): GenBank Accession No. NP_010311; Reg1p
MSTNLANYFAGKKDIENEHVNRNASHESNSKSDVKISGNDNDNDEDMGPSVSMAVQAKNDDDFHKSTFNLKRTRSMGLLDEYIDPTKKLLGRSDDLYDNDNEYYDNSSNNSSSNSSDDDYDDGYQEHSTSVSPPPADNDSYLIPQDDNDVVVEPERHVDYLSHEWKESEISNSWKYIILKKKKRDVDLVNAARLENASWRTWAKARNNLKTVSPEVVNWSKDSDVTWLYGPIVRDSEGNAQSEEEHDLERGYGSDDENSKRISMPTKNSKSIAAAPKPILKKRTVTEIIEDNALWKLNEARKHMTEMKHASVIMDPNGNKNVHDDFDALAAQVNAQYYHYPKESNSSVSLKSQHSDKKDNSTIPNPVGENSNGGGDKGEEDLHLKSALHVQNNRSTAQSNKSILENSTNDRKANLDQNLNSPDNNRFPSSTSSSNRDNENNSMGLSSILTSNPSEKSNKPTKNRHIHFNDRVEQCMALRYPASQSEDDESDDENKQYVDVNNNANVTTINNNRTPLLAIQHKSIPINSATEHLNKNTSDDDTSSQSSSSSHSDDEEHGGLYINARFSRRSDSGVHSPITDNSSVASSTTSRAHVRPIIKLLPDTTLNYGSDEESDNGEFNGYGNAVSHNVNTSRGYDYIYDYNSVYTGDTSSFLPVDSCDIVDVPEGMDLQTAIADDNASNYEFNNAVESKEKHVPQLHKASANNTTRQHGSHMLLYDDDNYSSSSDSEQQFIEDSQYNSSDDEEEEDDDDQEVDDNHDEGLSLRRTLSLGKSGSTNSLYDLAQPSLSSATPQQKNPTNFTGGKTDVDKDAQLAVRPYPLKRNSSSGNFIFNSDSEEESSSEEEQRPLPANSQLVNRSVLKGSVTPANISSQKKKALPKQPKASDSSQSFRIVNNTPSPAEVGASDVAIEGYFSPRNESIKSVVSGGNMMDHQDHSEMDTLAKGFENCHINNASKLKDKKVDSVQTTRKEASLTDSSNESLHKVVQNARGMASKYLHSWKKSDVKPQENGNDSS

SEQ ID NO: 57 - protein, 486 aa, Saccharomyces cerevisiae
  MISC_FEATURE (1)..(486): GenBank Accession No. NP_011261; Hxk2p
MVHLGPKKPQARKGSMADVPKELMQQIENFEKIFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVYNRYPGFKEKAANALKDIYGWTQTSLDDYPIKIVPAEDGSGAGAAVIAALAQKRIAEGKSVGIIGA

SEQ ID NO: 58 - DNA, 6023 bp, Artificial Sequence
  Plasmid pYLoxU-ECH
taactttggccggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgatacatctccctccttatataatcacacaggccagaacgcgctaaactaaagcgctttggacactatgttacattggcattgattgaactgaaaccacagtctccctcgcctgaatcgagcaatggatgttgtcggaagtcaacttcactagaagagcggttctatgccttgtcaagatcatatcataaactcactctgtattaccccatctatagaacacttgttatgaatgggcggaaacattccgctatatgcacctttccacactaatgcaaagatgtgcatcttcaacgggtagtaagactggttccgacttccgttgcatggagagcaatgacctcgataatgcgaacatcccccacatatacactcttacacaggccaatataatctgtgcatttactaaatatttaagtctatgcacctgcttgatgaaaagcggcacggatggtatcatctagtttccgccaatccaagaaccaactgtgttggcagtggtgtagcccatggcacacagaccaaagatgaaaatacagacatcggcggttcgagccgtggtgcctcgagcaacacccttgtaatgcaaaagaggagggtaaatgtacaccagaggcacacatgcaaacgatccggtgagagcgacgaaccgatcgagatcgtcggcacctccccatgcaacaaaggcggtgacaaacacaaggaagaaccggaaaatgttcttctgccacttgatggtagagttgtacttgcctgatcgggtgaagagaccattctcgatgattcggatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttagaagtgaggattacaagaagcctctggatatcaatgatgaacgtactcagcggctggtcaagcatttcgaccgtcgaatcgacgaggtgttcacctttgacaagcgagggttcccaattgatcacgttctcgagttgttcaaatcttctctcaacatctctctgcatgaactatctctgttgacgaacgtgtcacccactgttcctcgaacgcccttctccgagtttggtctgaacatcttcgatctcaaactgacccccgcagtgatcaatagtgccatgccactgccgatgcggtgcgaacatccctggagggattctcggagctctacacaatgcagattctgtcgtcgagtactctctaccttgctcgaatgacttattgtgctactactgcactcatgcttcgatcatgtgccctactgcaccccaaatttggtgatctgattgagacagagtaccctcttcagctgattcagaagatcatcagcaacatgaatgatgtggttgaccaggcaggctgttgtagtcacgtccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggaagcttatggatggtgtaatccccttaat

SEQ ID NO: 59 - DNA, 9182 bp, Artificial Sequence
  Plasmid pYRH28
cgcgcccgtattgtaacgtctgtcaagatctccgaccctcgggccggagttaaacgttactgggctttgttaccagacatcactgggtatggtataaatatggctgtggaatccgctgagggagccagaaaacgtcttcagacacaaacgcaaccacaacaacaaccataccaaaaatgcacggcagactcgacaactttttcgcagagagaccctaccttcctcacctgagatctcatgacaacagtctgactcaggatgctaagcccaccggagctccctttgcccctcccatggatttgtacgacaacgaaaagcagtacctgattcatctttctcttcccggagtgtttcccgacgatttggaggttgagactgatgctgatctgagactcattaccgtcaagggagtgttccgaaacccctacgaggacatgaacgagaatctcagaatcaacgagcgacgaagcggcgccttcgaacgacagatcaagttccccaagggcactgttgttgaggaagacaacatctctgccaagctgactaatggtgttttggagattagtctcaaaaaggtggagggtaaagagagagaggtcagacggattaaggtggagtgctgctaagcaaattacttgccagagactagtggtgaagcgattaatgatgaagaagtagctggattttgcaggagaacctgtactatactatgacttctccttcgtctgctacaactagttaagtaatgggtgttatcacaccatatgtatattgaatgaataatgaccactcttggattttgtatactgtagctccaacttttgctgtcatccaatttccactcatccagtcggtcacgcactatgctcgttccgtaactccagtcacaagtaaatctctggatccgtacattactgatcgactcgaaagacccctgttcaccatggttataccactaccatcagtctcagaaacactagaaaatctccgtagaccgtctcataccgccttcaatgttgtctacagttggtatgggctggtacctggcattcaagccaactgccaatcaaagaacgagagagattcaattacggaactaatgtgtgcttgtatttgtaccgttacccttggttcatctcctttataatgtacccatacatatcaacaattcgagtcacgtgacctgccctgtcctccctcttggggctgatcatacagacgtgcatcattaatattgtagaaaagaggaatacagctgagacgtcacccaaggggggtatttgagtgcgtggtatgtgtttttatacccatccatcccctttcaacttcacatcactctttcatctccaccctacaggccaactaattgtctattagtccagttacgatatcgtacttacggctcaccatgactccaaccacacagcccaccaactactggaatgaggatcgtgagaaacgcttcttgtgtacagggtgtaacattgtcatgtcgaagaaagaagctcgaactcatcacttgtttgtctcctgtcgaagcggcttcctcagggtgtaattgagctccttgggggcaggcccagctggacgtcatgcatacatctatttattttaattcaacaaatgctacaagtaatttcaactattttcctgatttagttggcatattttctgcaatgtcgagtatgttcatccagaactaagtgtgacttaattgaacaaatttgtattactgttgttgtacctgtgttaaaagttgcacttttacgactacaagtactttttacaggtatcaggtgtgttatttgtaagaatcacctctttattcgcccactgagaccctctcattccgactccttttcgtgtgctgttccccttcaagtacagtacatcccattcctgatgacataatcctatttgcctcatttgggagtttgctggggatggcataaaatgtctcaaaaaggtcccaaaagtactccgattgtaaatctgaagccaccaatagatttctcgtgcccacattaaagtacaaaagtggcactatttccgtaccaaatcgatctcatcatcccccaacaatcctcacccaacctcatcctccagcgacttgagttttaacttaactttgacgtcgataaattcacccactctgcaacgacactgaggaccagcaacagtgattgtggagctacactgacgatacaagcacgataggaggcccatcgacgcgtgacgacacttgaaatacgacagacaagctataccattaaacagctctcacaaagcaaccataaacacatacacagaatccaacacacacaccccatacgttcagaatcccacaaaacacaagacacaagccacacacgtacgttgtgtggaagcttgtgagcggataacaatttcacacaggaaacagctatgaccatgattacgccaagctcgaaattaaccctcactaaagggaacaaaagctggagctccaccgcggacacaatatctggtcaaatttcagtttcgttacatttaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatacgctctcatcaagaatacttcttgagaaccgtggagaccggggttcgattccccgtatcggagtgtttattttttgctcaaccataccctggggtgtgttctgtggagcattctcacttttggtaaacgacattgcttcaagtgcagcggaatcaaaaagtataaagtgggcagcgagtatacctgtacagactgtaggcgataactcaatccaattaccccccacaacatgactggccaaactgatctcaagactttattgaaatcagcaacaccgattctcaatgaaggcacatacttcttctgcaacattcacttgacgcctaaagttggtgagaaatggaccgacaagacatattctgctatccacggactgttgcctgtgtcggtggctacaatacgtgagtcagaagggctgacggtggtggttcccaaggaaaaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagaattcaagatactatcaagacatgtgtcgcaacttaattaactcttcttgtgactgtgactgtggctgtggctgtggctgtggctgtgattgtgatgatgttcagggaaaaatcctccaatatgggggtgtcgtagtccagtggcagccgaagcagctcctgtcagatggtgactggcaacatgggccttgtctcgcagctctctctgtagagaaatgaacgactgggaggccgaaggagtgccggagggcgtgtttgaagcagagttagatgagttggagccatcaaagtcccgctcctccttctcgaaagatccccgtcgcggctcaaacgaaatgttctccaacgcacgcgacatctttcgggcaggtcgcgagttgttgaacatgttagtgaaccgctcagcaacggtatcgtcatcaatggtggccgaagaagacgctgtggatgctgcagagtgcgttctagcaacctccagcgtagatgcagacgatctctgagaccgggtggagtttgcaaacagcacctttttgcttcgaggcagctccagctgcgtgtccacctcttccaacacctcgtcatcgtcctcttcaatggcagactcggtgtctgtgatggcccgcaggtcagctggttgagccaggcccgagtagttaacgcttctgagccggtccagctcctccatctcttccagctgctcaaaagtagcaataccagacacctgggatcgagatcgcatgtactgagatcgtcggttgaaagaggagcctgaactagaagatgaggaaatagaaggacgttttgccatggacgtggctggcgtggtagactcgtcgtcagagtaggtcaacgaagaccgaggagaacaagaagacactgtccccatggaaacaatactgttcattctatccgaggacattcgctcggacatcctctcggaggagttcgataccagaggtccaactcgaccgcgcagcttcagagatacttctgcagcagccatgatcacattgtaattttcggggttgtcgaaaatggcatcgtgggttcgagtgagggtcgagaacatgttgaagcgagacactcggtcatgaacacgcttggactcgttaagagtggccaggccgggaccaggaatgtacccggattgagaaaaggcccggcgagtggacagaagacgtcggttttcgccttcagaagacacaatcgaggcagtttcacccagttgagggtattctcgacacatgtctgaggacacaaaccggaccacaataacagtcacattgtcggctgctccatgtttgagcgcatatgagaccagagtgtcggaagcaactttacaatcatcaacatgtcgaatcaaatcaacacaggtttgatcgtcaacaacatcccagaggccgtttgaggccagaatgaggaactcatccgcagccccaagaacggtatcggatacaaatggccgggacgaaatgtaccgtttgaagctcttgtctccgagagatctggtgactctgtggagaccgtcaaccttgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgg

SEQ ID NO: 60 - DNA, 2364 bp, Yarrowia lipolytica
cgtattgtaacgtctgtcaagatctccgaccctcgggccggagttaaacgttactgggctttgttaccagacatcactgggtatggtataaatatggctgtggaatccgctgagggagccagaaaacgtcttcagacacaaacgcaaccacaacaacaaccataccaaaaatgcacggcagactcgacaactttttcgcagagagaccctaccttcctcacctgagatctcatgacaacagtctgactcaggatgctaagcccaccggagctccctttgcccctcccatggatttgtacgacaacgaaaagcagtacctgattcatctttctcttcccggagtgtttcccgacgatttggaggttgagactgatgctgatctgagactcattaccgtcaagggagtgttccgaaacccctacgaggacatgaacgagaatctcagaatcaacgagcgacgaagcggcgccttcgaacgacagatcaagttccccaagggcactgttgttgaggaagacaacatctctgccaagctgactaatggtgttttggagattagtctcaaaaaggtggagggtaaagagagagaggtcagacggattaaggtggagtgctgctaagcaaattacttgccagagactagtggtgaagcgattaatgatgaagaagtagctggattttgcaggagaacctgtactatactatgacttctccttcgtctgctacaactagttaagtaatgggtgttatcacaccatatgtatattgaatgaataatgaccactcttggattttgtatactgtagctccaacttttgctgtcatccaatttccactcatccagtcggtcacgcactatgctcgttccgtaactccagtcacaagtaaatctctggatccgtacattactgatcgactcgaaagacccctgttcaccatggttataccactaccatcagtctcagaaacactagaaaatctccgtagaccgtctcataccgccttcaatgttgtctacagttggtatgggctggtacctggcattcaagccaactgccaatcaaagaacgagagagattcaattacggaactaatgtgtgcttgtatttgtaccgttacccttggttcatctcctttataatgtacccatacatatcaacaattcgagtcacgtgacctgccctgtcctccctcttggggctgatcatacagacgtgcatcattaatattgtagaaaagaggaatacagctgagacgtcacccaaggggggtatttgagtgcgtggtatgtgtttttatacccatccatcccctttcaacttcacatcactctttcatctccaccctacaggccaactaattgtctattagtccagttacgatatcgtacttacggctcaccatgactccaaccacacagcccaccaactactggaatgaggatcgtgagaaacgcttcttgtgtacagggtgtaacattgtcatgtcgaagaaagaagctcgaactcatcacttgtttgtctcctgtcgaagcggcttcctcagggtgtaattgagctccttgggggcaggcccagctggacgtcatgcatacatctatttattttaattcaacaaatgctacaagtaatttcaactattttcctgatttagttggcatattttctgcaatgtcgagtatgttcatccagaactaagtgtgacttaattgaacaaatttgtattactgttgttgtacctgtgttaaaagttgcacttttacgactacaagtactttttacaggtatcaggtgtgttatttgtaagaatcacctctttattcgcccactgagaccctctcattccgactccttttcgtgtgctgttccccttcaagtacagtacatcccattcctgatgacataatcctatttgcctcatttgggagtttgctggggatggcataaaatgtctcaaaaaggtcccaaaagtactccgattgtaaatctgaagccaccaatagatttctcgtgcccacattaaagtacaaaagtggcactatttccgtaccaaatcgatctcatcatcccccaacaatcctcacccaacctcatcctccagcgacttgagttttaacttaactttgacgtcgataaattcacccactctgcaacgacactgaggaccagcaacagtgattgtggagctacactgacgatacaagcacgataggaggcccatcgacgcgtgacgacacttgaaatacgacagacaagctataccattaaacagctctcacaaagcaaccataaacacatacacagaatccaacacacacaccccatacgttcagaatcccacaaaacacaagacacaagccacaca

SEQ ID NO: 61 - DNA, 1493 bp, Yarrowia lipolytica
ctcttcttgtgactgtgactgtggctgtggctgtggctgtggctgtgattgtgatgatgttcagggaaaaatcctccaatatgggggtgtcgtagtccagtggcagccgaagcagctcctgtcagatggtgactggcaacatgggccttgtctcgcagctctctctgtagagaaatgaacgactgggaggccgaaggagtgccggagggcgtgtttgaagcagagttagatgagttggagccatcaaagtcccgctcctccttctcgaaagatccccgtcgcggctcaaacgaaatgttctccaacgcacgcgacatctttcgggcaggtcgcgagttgttgaacatgttagtgaaccgctcagcaacggtatcgtcatcaatggtggccgaagaagacgctgtggatgctgcagagtgcgttctagcaacctccagcgtagatgcagacgatctctgagaccgggtggagtttgcaaacagcacctttttgcttcgaggcagctccagctgcgtgtccacctcttccaacacctcgtcatcgtcctcttcaatggcagactcggtgtctgtgatggcccgcaggtcagctggttgagccaggcccgagtagttaacgcttctgagccggtccagctcctccatctcttccagctgctcaaaagtagcaataccagacacctgggatcgagatcgcatgtactgagatcgtcggttgaaagaggagcctgaactagaagatgaggaaatagaaggacgttttgccatggacgtggctggcgtggtagactcgtcgtcagagtaggtcaacgaagaccgaggagaacaagaagacactgtccccatggaaacaatactgttcattctatccgaggacattcgctcggacatcctctcggaggagttcgataccagaggtccaactcgaccgcgcagcttcagagatacttctgcagcagccatgatcacattgtaattttcggggttgtcgaaaatggcatcgtgggttcgagtgagggtcgagaacatgttgaagcgagacactcggtcatgaacacgcttggactcgttaagagtggccaggccgggaccaggaatgtacccggattgagaaaaggcccggcgagtggacagaagacgtcggttttcgccttcagaagacacaatcgaggcagtttcacccagttgagggtattctcgacacatgtctgaggacacaaaccggaccacaataacagtcacattgtcggctgctccatgtttgagcgcatatgagaccagagtgtcggaagcaactttacaatcatcaacatgtcgaatcaaatcaacacaggtttgatcgtcaacaacatcccagaggccgtttgaggccagaatgaggaactcatccgcagccccaagaacggtatcggatacaaatggccgggacgaaatgtaccgtttgaagctcttgtctccgagagatctggtgactctgtggagaccgtcaacctt

SEQ ID NO: 62 - DNA, 32 bp, Artificial Sequence
  Primer SNF4Fii
caacaacaacaacaatactctaactcctctgg

SEQ ID NO: 63 - DNA, 36 bp, Artificial Sequence
  Primer SNF4Rii
tatccagacggtcctgattagtgcatgtgtacacgc

SEQ ID NO: 64 - DNA, 33 bp, Artificial Sequence
  Primer SNF4-conf
gaacgtgaaagagtcgtggctagtggaggtctg

SEQ ID NO: 65 - DNA, 8100 bp, Artificial Sequence
  Plasmid pYRH30
cgcgccctgttaatacataatacaccacccagtccggggtttctgttgtttttttctgttgttttgtctgttgttttctgcatcatctggccacttttgatactttcaaccaagagcgccaactaactccaactaacttccaatgtcccgactaaaccgctcaatcttctccttgctaggcctcggaaaaacgccgcatgtgtgcagcaaggcaacggaaggtcacgtggaacgcaaaagtatacccgctagagcagcccggtggacctgtggacgtgaccacccaccgcccgggtggggaaggccctgcgttggggccgataggcgagaaaaccactcgaaaatcgctcaaataattattcctagcctgactgttgcagctcacctttattttccagcgtgtgccccactgtgtcctgacacacactgtttatttttgacatgtgtgaatggctggcgcggatgtagacaccggatcccggacccggtcggcagcgcaaacggcgcccgtaaccagccctataaccaccgcaaaaaacatgcgccggggaacgcaaaaagaatggcggctctggcccgtcgcttgccccgccgtccacttgttgaaggacgcaccatgttcgttatctgaccgttgccgttacgtgtagattaaacttttgggcaaatccaaaatatctacgggtgcgaaacgctgtctagtcctctctctctccaagcgtactcttcgagcaacaccactgctggatcccgtacgttgtgtggaagcttgtgagcggataacaatttcacacaggaaacagctatgaccatgattacgccaagctcgaaattaaccctcactaaagggaacaaaagctggagctccaccgcggacacaatatctggtcaaatttcagtttcgttacatttaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatacgctctcatcaagaatacttcttgagaaccgtggagaccggggttcgattccccgtatcggagtgtttattttttgctcaaccataccctggggtgtgttctgtggagcattctcacttttggtaaacgacattgcttcaagtgcagcggaatcaaaaagtataaagtgggcagcgagtatacctgtacagactgtaggcgataactcaatccaattaccccccacaacatgactggccaaactgatctcaagactttattgaaatcagcaacaccgattctcaatgaaggcacatacttcttctgcaacattcacttgacgcctaaagttggtgagaaatggaccgacaagacatattctgctatccacggactgttgcctgtgtcggtggctacaatacgtgagtcagaagggctgacggtggtggttcccaaggaaaaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagaattcaagatactatcaagacatgtgtcgcaacttaattaaaggtggaaatgaggaaatgaggaaggaggttatatagagtgtcgcagtacgtacagtaattagcatagatgtatttggcgataaggacattaggagagcacccgtaatgaagagatcaaaaggaacagtatgatctatgacaggtgttcctgtacacttgcttcactcgcttcactagacagtgcatatatcgtgtgaatgttatcaatctactgtatattccgtgtacatactatataatacctcagacaaatacaactcaatagtgcagctgcgaagctggaaatcgaaaaatcaactcttcttgccatcctctaagagcacacaaaaactcatgaaaaattgacctttccatctcactgctttgaagggtccataatgatgaggttcaaaattgatatgaaaccttattaaaacttcctttatcaatcttcttgtacagacttgtttgaatatatacaaatacgagtagtggagttgcacaactttgggtggcgtcaattgataggttatcggagttattcatcatcatcaaaataaaccagtgcacaatggcttcgaattatcattatcattattatcgttaggtaagcacttgaataccgtcactctccaagagcatcgtaaatagcctcccaatccttgaccaaagccgcatagaaatccacctgtccagaggtcagagtcttgagagtctccttcatctcgccggatcgaatcttgtcgaaagtgttaatctcgcgcttggtctgctcgtcaaaggcctcggacgtggtcttggccagattcgtctcgcccgtgagactctcgatccggccctcgagcttctgcagccgttcccgtcgtgaaaactcatggttgataccccgaatgtcctccagcttgtttcgcagaataccgttccctccaccagacaccagcgcctgtctttcggccacagctcgctcattgtactccaccaggccctcgtagtctgcctgcttctggtctcgttgtttgagcaaagctctgaccgacacaagatagtgcatgagatccttgagagaagacacgtagtcggtatcaagtttctccttgagcacggctgtgttgatggccagcgcctgcaggcctccagcaaacttggaaaactcttgttccaatgaaggaatcagatgctccagctggcccacgtgctgcgacaggtcctggtagtccatgaccagatctgactgtcgacgcacagaccgagccagtaccttttcaatgtgcgacacacacacgtccaggcggtcgattcgttccttgacctcctggaactcctgggccgtctgtgggggtcgagtgaatgcactgaccagcgtgtcggacagtccgtccaaaattcctccgtccacaatcagtcctcctcgtgcaatgttgtttttcttgtatgcgttccattcgccagactccagaaaggcgtggtagtatttggaccgtttgagcagggggtgatgtgctatgcgtgagagaaaccgtgtcagagatgctgctcgcttgactgtgaactctgtcgaaaaccggtcccctcgaatgtactcgagacgctgcttgtccgggagagggggcaccacacaggcctggaactcgttgttcaggcagttgtaaaggaagacaaagtccgaaaaccggcgtcggactcggaactccttgttcgagaactgcgtgttgttggacttggtcgtcacgaggtatgtgatgtgggcgttctgggttccatccaggtctttggccggatcgctcaccacagagtcgatataagtcttgtcattttcgagcgcatggtagtcgcttcgatacaggtctgtgtctgagtgcgacgagggtccgttggacgatgacgctatgccgttagaaggaccactcgaaggccccgcttcatcttgccattccatcgtatgcagtgagagtgtgtgatggggtttgatggggtgtggttgtagttgtagttgttgctgttgttggagtggggctctttgtgacttgtcgtcttgttctgtgtctgtgccgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgg

SEQ ID NO: 66 - DNA, 9963 bp, Artificial Sequence
  Plasmid pYRH33
cgcgcctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagactttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggcccagccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaaagctggcgactgcacccaacgagtgtggtggtagcttgttactgtatattcggtaagatatattttgtggggtttttagtggtgtttggtaggttagtgtctggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccatggcttttggcactgtatttcatttttagaggtacactacatccagtgaggtatggtaaggttgagggcataatgaaggcaccttgtactgacagtcacagacctctcaccgagaattttatgagatatactcgggttcattttaggctccgattcgattcaaattattactgtcgaaatcggttgagcatccgttgatttccgaacagatctcggcagtctctcggatgtagaattaggtttccttgaggcgagatgagacggtaagttggaggggtttgagaagagatagagatcggtttgtgtgacatgaattcttcaaaacacgattcataactgactggcactttctctcatccaatcaactgaaccattcccactctataagaagatctactcatcgcttctctccattatcctaatgtttgatccatttagagtgcaagcaccaaagtcggttcagtacagtaaccatactgcaacaaccaagttgtcaaggctgtctccctcggctttgtaacgccaggcgtttctgttttcgtccactgcaaccatgcagtgtcacgacagaggcgtgtggtctgtacagtgcattcagttcgtttttgtatccttacgtggcctgtcagattgaaagatttttcagatcaccccttcgctggttctttgttatgatacgtatgagatgagtagagctatggggtgtgtgttttaggaccctttctcgacgactaaatttgctatttccccacattaaaacaactaacctcgataaagtggacttcacgtgtgtaagaaggctacaagagcgagtacatacgagatatgccgtgtgcttcttgtactgcctgttgcactgcttgttgtacttcctcgtactgcttgttgcactgtatgtgggggtggtgttgttgtactgtagacgtattgaccttccttgtacggctccttgtatggctcgtatttatatgcgtctctttttttgttcttggctctacccctaatactcgtccttacatgacgctttagttgacgtcttgtgggtgtctatctcatcgggtttagctggtcatccccctgcaccaccgagcaacaatagctaccggcatgtgagacactggaggcagaggcagagaaaaagcaaagggtaaagtgagcaaggagtttcacggatttggcttaataggatgtggcgttccactgatgacttttgtctctctagagcggttgagaatagtttggcactggtctttggcgttggtagcgttctcacacactgtccaagttgacgtcagcggccgcagcctctgtttcagcctcaaaacaggttctattgttgccattgttaccctgtctcctatctgatgctctcccttgtatcgagcaaataagacaatttaacgtgcatacaaagggctattgttggctcgagttgattggccagtttggggcaacaatggtagctgatccagggtccttgagttcaaaatgggggggaaaccatgtacccagcacgacaagtttctctcgggtgcccccatcaactctttccacaaatacatccaagattgctgtggatgtggctgcgtgggagatgggagttgcagtgtggttgccgaaagcggcagcgatgtgcatcttgtggcaagagagttaaaaaaaaaaaagatagaaaaaaaagggttacggcgaaaagaaatattaagtggtccgactgggtcgtgtggtgcactttgttaggaaagacggaatgtaaatcagtcgtcagtttgggtgtttaaaccggtgcagagagaacatcaactctcacgccccctcccctccgcagttgatgtctgtccaaaccattaaccccttgataaattgtcattttgataacaagatatgccactaatgctgtaaaccaaattcgacatctttattcagacacctgtccgttgtccacaaaaatgcttttaccccactgtaaggacaaaacgtagagtgtaccagaggttgactttctgtctttaagctcagacttggtgtggagaaggacaaggttccagcactctgacatgaccccagcatcattctaatctcttttggatcaagtttaacatactcttggaatatctatagcacccagagaccttgacttctgcctcaacaccgtacgttgtgtggaagcttgtgagcggataacaatttcacacaggaaacagctatgaccatgattacgccaagctcgaaattaaccctcactaaagggaacaaaagctggagctccaccgcggacacaatatctggtcaaatttcagtttcgttacatttaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatacgctctcatcaagaatacttcttgagaaccgtggagaccggggttcgattccccgtatcggagtgtttattttttgctcaaccataccctggggtgtgttctgtggagcattctcacttttggtaaacgacattgcttcaagtgcagcggaatcaaaaagtataaagtgggcagcgagtatacctgtacagactgtaggcgataactcaatccaattaccccccacaacatgactggccaaactgatctcaagactttattgaaatcagcaacaccgattctcaatgaaggcacatacttcttctgcaacattcacttgacgcctaaagttggtgagaaatggaccgacaagacatattctgctatccacggactgttgcctgtgtcggtggctacaatacgtgagtcagaagggctgacggtggtggttcccaaggaaaaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagaattcaagatactatcaagacatgtgtcgcaacttaattaagatacacgcgacttatccgtattgtagttgccatagttacttgtatagcagaggcagatcacaaacttttctcgccggctactgtacattccgcacactaaagccagttgtttaaatgtaacggggagacttgcttattctacatggttccatgtggtttcccaccgcttgtgacgatagcccatgaccagtgcgaagttcgaagtgcccagcagctattatattagagccaaaaactgagcgtctatatttttcagccagccaaggcagggtctgagcgaggtgttctgttatgtatcttgtttcactgactgcggggaatgggcatgttactcaacagatttattctctgagacagcagcttggatgtagcacgtgagaccggagtttttgcactttaccaatacacgcgtgtgtgttttctgcgcagatcaaccctgtaattctcgttccagaaaccactttaggctccactccaaagatcgacttttagctgtgacgacgctacgctgcaatgccctgcaataggcggataaaaacaaaagtcgctcttatgcttcttgcgctaggatatgcttatgcgggagcatgggttattggcaaatgtttgaacgattgcaaatagtggcggatttaccactctcgtatttgtgttcgtatttcgggttgtctatttccatcctctctttgcggctgagggggcgccttgttcctacatgctccattacgtcacggagtcgtaaaactacttgccctttgccgtgcgtgttagcctttttagttaggcttttggggtaggccacaccgcaccaccttagaagcccggagtgcgatttggcttcaaaaaattatggaacaatttaccgtcttgggtgtgagtgtacatcccacggaatatccggctgaccaagataggtgcaagttttaccctgtaagttctccatggctccaatgcactgttcttgtgctatctgcctgtttgagcgtgctacagtggatgctcactcggtctaattactgtagctccttagttttcaaatcatgcatattgctcataaatattccgacccaattaaaagagaagtccgagagtgttctcataaatcttcatgccccggccgggggggttgagttctcgctcccgagcctgctcggcaaggaactcctcctcctgacgatcaatcacgtccttgtaagtgtagaaatcggcctcctcaggctgcaccatcttggtcttgtagaagaacttgtagcccaggttgagagccaagaacagaggaatacccaggtatccggtgatgaagttcttgtagtcaaagccgttgatgaagacggtgaagttcttgaagatcgagatgagaatgcaaaagaagagggcaaagtaggagccgtagggctggaagggggcacaccacacgagatctcggtgtcggtcaatgccctgggccttgcaagctctcatgaagaaaatgtgggtgacaagaatggaaacccaagtgagcaagccgaaaatggacaccaggttgacaaagtagccaaaaacggtctcggaagaagacgagacgttgaggtaggccagagcacagaagcaagtggacagtcccatggcgtagacgggaagaccgtgcttggtggttcgggaaaagatggcgggagcctttccgttgacagcaagaccgtagagggttcgagtggcaatgtagaggcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgg

SEQ ID NO: 67 - DNA, 745 bp, Yarrowia lipolytica
ctgttaatacataatacaccacccagtccggggtttctgttgtttttttctgttgttttgtctgttgttttctgcatcatctggccacttttgatactttcaaccaagagcgccaactaactccaactaacttccaatgtcccgactaaaccgctcaatcttctccttgctaggcctcggaaaaacgccgcatgtgtgcagcaaggcaacggaaggtcacgtggaacgcaaaagtatacccgctagagcagcccggtggacctgtggacgtgaccacccaccgcccgggtggggaaggccctgcgttggggccgataggcgagaaaaccactcgaaaatcgctcaaataattattcctagcctgactgttgcagctcacctttattttccagcgtgtgccccactgtgtcctgacacacactgtttatttttgacatgtgtgaatggctggcgcggatgtagacaccggatcccggacccggtcggcagcgcaaacggcgcccgtaaccagccctataaccaccgcaaaaaacatgcgccggggaacgcaaaaagaatggcggctctggcccgtcgcttgccccgccgtccacttgttgaaggacgcaccatgttcgttatctgaccgttgccgttacgtgtagattaaacttttgggcaaatccaaaatatctacgggtgcgaaacgctgtctagtcctctctctctccaagcgtactcttcgagcaacaccactgctggatcc

SEQ ID NO: 68 - DNA, 2030 bp, Yarrowia lipolytica
aggtggaaatgaggaaatgaggaaggaggttatatagagtgtcgcagtacgtacagtaattagcatagatgtatttggcgataaggacattaggagagcacccgtaatgaagagatcaaaaggaacagtatgatctatgacaggtgttcctgtacacttgcttcactcgcttcactagacagtgcatatatcgtgtgaatgttatcaatctactgtatattccgtgtacatactatataatacctcagacaaatacaactcaatagtgcagctgcgaagctggaaatcgaaaaatcaactcttcttgccatcctctaagagcacacaaaaactcatgaaaaattgacctttccatctcactgctttgaagggtccataatgatgaggttcaaaattgatatgaaaccttattaaaacttcctttatcaatcttcttgtacagacttgtttgaatatatacaaatacgagtagtggagttgcacaactttgggtggcgtcaattgataggttatcggagttattcatcatcatcaaaataaaccagtgcacaatggcttcgaattatcattatcattattatcgttaggtaagcacttgaataccgtcactctccaagagcatcgtaaatagcctcccaatccttgaccaaagccgcatagaaatccacctgtccagaggtcagagtcttgagagtctccttcatctcgccggatcgaatcttgtcgaaagtgttaatctcgcgcttggtctgctcgtcaaaggcctcggacgtggtcttggccagattcgtctcgcccgtgagactctcgatccggccctcgagcttctgcagccgttcccgtcgtgaaaactcatggttgataccccgaatgtcctccagcttgtttcgcagaataccgttccctccaccagacaccagcgcctgtctttcggccacagctcgctcattgtactccaccaggccctcgtagtctgcctgcttctggtctcgttgtttgagcaaagctctgaccgacacaagatagtgcatgagatccttgagagaagacacgtagtcggtatcaagtttctccttgagcacggctgtgttgatggccagcgcctgcaggcctccagcaaacttggaaaactcttgttccaatgaaggaatcagatgctccagctggcccacgtgctgcgacaggtcctggtagtccatgaccagatctgactgtcgacgcacagaccgagccagtaccttttcaatgtgcgacacacacacgtccaggcggtcgattcgttccttgacctcctggaactcctgggccgtctgtgggggtcgagtgaatgcactgaccagcgtgtcggacagtccgtccaaaattcctccgtccacaatcagtcctcctcgtgcaatgttgtttttcttgtatgcgttccattcgccagactccagaaaggcgtggtagtatttggaccgtttgagcagggggtgatgtgctatgcgtgagagaaaccgtgtcagagatgctgctcgcttgactgtgaactctgtcgaaaaccggtcccctcgaatgtactcgagacgctgcttgtccgggagagggggcaccacacaggcctggaactcgttgttcaggcagttgtaaaggaagacaaagtccgaaaaccggcgtcggactcggaactccttgttcgagaactgcgtgttgttggacttggtcgtcacgaggtatgtgatgtgggcgttctgggttccatccaggtctttggccggatcgctcaccacagagtcgatataagtcttgtcattttcgagcgcatggtagtcgcttcgatacaggtctgtgtctgagtgcgacgagggtccgttggacgatgacgctatgccgttagaaggaccactcgaaggccccgcttcatcttgccattccatcgtatgcagtgagagtgtgtgatggggtttgatggggtgtggttgtagttgtagttgttgctgttgttggagtggggctctttgtgacttgtcgtcttgttctgtgtctgtgcc

SEQ ID NO: 69 - DNA, 2933 bp, Yarrowia lipolytica
tgccgccatgatgctcaagttctctcttaacatgaagcccgccggtgacgctgttgaggctgccgtcaaggagtccgtcgaggctggtatcactaccgccgatatcggaggctcttcctccacctccgaggtcggagactttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggcccagccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaaagctggcgactgcacccaacgagtgtggtggtagcttgttactgtatattcggtaagatatattttgtggggtttttagtggtgtttggtaggttagtgtctggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccatggcttttggcactgtatttcatttttagaggtacactacatccagtgaggtatggtaaggttgagggcataatgaaggcaccttgtactgacagtcacagacctctcaccgagaattttatgagatatactcgggttcattttaggctccgattcgattcaaattattactgtcgaaatcggttgagcatccgttgatttccgaacagatctcggcagtctctcggatgtagaattaggtttccttgaggcgagatgagacggtaagttggaggggtttgagaagagatagagatcggtttgtgtgacatgaattcttcaaaacacgattcataactgactggcactttctctcatccaatcaactgaaccattcccactctataagaagatctactcatcgcttctctccattatcctaatgtttgatccatttagagtgcaagcaccaaagtcggttcagtacagtaaccatactgcaacaaccaagttgtcaaggctgtctccctcggctttgtaacgccaggcgtttctgttttcgtccactgcaaccatgcagtgtcacgacagaggcgtgtggtctgtacagtgcattcagttcgtttttgtatccttacgtggcctgtcagattgaaagatttttcagatcaccccttcgctggttctttgttatgatacgtatgagatgagtagagctatggggtgtgtgttttaggaccctttctcgacgactaaatttgctatttccccacattaaaacaactaacctcgataaagtggacttcacgtgtgtaagaaggctacaagagcgagtacatacgagatatgccgtgtgcttcttgtactgcctgttgcactgcttgttgtacttcctcgtactgcttgttgcactgtatgtgggggtggtgttgttgtactgtagacgtattgaccttccttgtacggctccttgtatggctcgtatttatatgcgtctctttttttgttcttggctctacccctaatactcgtccttacatgacgctttagttgacgtcttgtgggtgtctatctcatcgggtttagctggtcatccccctgcaccaccgagcaacaatagctaccggcatgtgagacactggaggcagaggcagagaaaaagcaaagggtaaagtgagcaaggagtttcacggatttggcttaataggatgtggcgttccactgatgacttttgtctctctagagcggttgagaatagtttggcactggtctttggcgttggtagcgttctcacacactgtccaagttgacgtcagcggccgcagcctctgtttcagcctcaaaacaggttctattgttgccattgttaccctgtctcctatctgatgctctcccttgtatcgagcaaataagacaatttaacgtgcatacaaagggctattgttggctcgagttgattggccagtttggggcaacaatggtagctgatccagggtccttgagttcaaaatgggggggaaaccatgtacccagcacgacaagtttctctcgggtgcccccatcaactctttccacaaatacatccaagattgctgtggatgtggctgcgtgggagatgggagttgcagtgtggttgccgaaagcggcagcgatgtgcatcttgtggcaagagagttaaaaaaaaaaaagatagaaaaaaaagggttacggcgaaaagaaatattaagtggtccgactgggtcgtgtggtgcactttgttaggaaagacggaatgtaaatcagtcgtcagtttgggtgtttaaaccggtgcagagagaacatcaactctcacgccccctcccctccgcagttgatgtctgtccaaaccattaaccccttgataaattgtcattttgataacaagatatgccactaatgctgtaaaccaaattcgacatctttattcagacacctgtccgttgtccacaaaaatgcttttaccccactgtaaggacaaaacgtagagtgtaccagaggttgactttctgtctttaagctcagacttggtgtggagaaggacaaggttccagcactctgacatgaccccagcatcattctaatctcttttggatcaagtttaacatactcttggaatatctatagcacccagagaccttgacttctgcctcaacac

SEQ ID NO: 70 - DNA, 1708 bp, Yarrowia lipolytica
taagatacacgcgacttatccgtattgtagttgccatagttacttgtatagcagaggcagatcacaaacttttctcgccggctactgtacattccgcacactaaagccagttgtttaaatgtaacggggagacttgcttattctacatggttccatgtggtttcccaccgcttgtgacgatagcccatgaccagtgcgaagttcgaagtgcccagcagctattatattagagccaaaaactgagcgtctatatttttcagccagccaaggcagggtctgagcgaggtgttctgttatgtatcttgtttcactgactgcggggaatgggcatgttactcaacagatttattctctgagacagcagcttggatgtagcacgtgagaccggagtttttgcactttaccaatacacgcgtgtgtgttttctgcgcagatcaaccctgtaattctcgttccagaaaccactttaggctccactccaaagatcgacttttagctgtgacgacgctacgctgcaatgccctgcaataggcggataaaaacaaaagtcgctcttatgcttcttgcgctaggatatgcttatgcgggagcatgggttattggcaaatgtttgaacgattgcaaatagtggcggatttaccactctcgtatttgtgttcgtatttcgggttgtctatttccatcctctctttgcggctgagggggcgccttgttcctacatgctccattacgtcacggagtcgtaaaactacttgccctttgccgtgcgtgttagcctttttagttaggcttttggggtaggccacaccgcaccaccttagaagcccggagtgcgatttggcttcaaaaaattatggaacaatttaccgtcttgggtgtgagtgtacatcccacggaatatccggctgaccaagataggtgcaagttttaccctgtaagttctccatggctccaatgcactgttcttgtgctatctgcctgtttgagcgtgctacagtggatgctcactcggtctaattactgtagctccttagttttcaaatcatgcatattgctcataaatattccgacccaattaaaagagaagtccgagagtgttctcataaatcttcatgccccggccgggggggttgagttctcgctcccgagcctgctcggcaaggaactcctcctcctgacgatcaatcacgtccttgtaagtgtagaaatcggcctcctcaggctgcaccatcttggtcttgtagaagaacttgtagcccaggttgagagccaagaacagaggaatacccaggtatccggtgatgaagttcttgtagtcaaagccgttgatgaagacggtgaagttcttgaagatcgagatgagaatgcaaaagaagagggcaaagtaggagccgtagggctggaagggggcacaccacacgagatctcggtgtcggtcaatgccctgggccttgcaagctctcatgaagaaaatgtgggtgacaagaatggaaacccaagtgagcaagccgaaaatggacaccaggttgacaaagtagccaaaaacggtctcggaagaagacgagacgttgaggtaggccagagcacagaagcaagtggacagtcccatggcgtagacgggaagaccgtgcttggtggttcgggaaaagatggcgggagcctttccgttgacagcaagaccgtagagggttcgagtggcaatgtagag

SEQ ID NO: 71 - DNA, 20 bp, Artificial Sequence
  Primer GAL83-367F
gacgacgatatccccttcga

SEQ ID NO: 72 - DNA, 16 bp, Artificial Sequence
  Primer GAL83-430R
gcggcttgggctcgtt

SEQ ID NO: 73 - DNA, 19 bp, Artificial Sequence
  Primer SIP2-827F
ccggctggagaaagatgct

SEQ ID NO: 74 - DNA, 19 bp, Artificial Sequence
  Primer SIP2-889R
ccagggtgacggaaaaggt

SEQ ID NO: 75 - DNA, 26 bp, Artificial Sequence
  Nucleotide portion of primer GAL83-388T
aaactcaacatcacccatcccacatc

SEQ ID NO: 76 - DNA, 23 bp, Artificial Sequence
  Nucleotide portion of primer SIP2-847T
cctatggatcgccagtcagacgg

SEQ ID NO: 77 - DNA, 9624 bp, Artificial Sequence
  Plasmid pYRH31
cgcgccctgtagtagcgtattgttgtggtgtatcgtatcggttaaggggtgtcgtggataagaatgcactgtggggaagagttgtttaatgaagtgcatgtaatcagctgatggagttgaaaaaggcaaaagacattgtgagtaacagtgtttgttctgggtaccaatgtgtatctaagagagattgttggtttggtccccagattccaacccagctagacctttcaccaacaacttaccaaagtattagacagccgacccaatcgttaccgatagctcgctattgctgcgtttagcgctcttatcgcttttaccttcgaggcgtatcggaacttaatatgcgtgggggtagcagtaggaagctcgactggtatgtgtattggtatactgtttctactgtagtgatatttgaagatgatggtttgtaccaattcaattgcaaatacaagatacttcagtcgttgcacaatttcgggatctgtaatgaccatatcagtacatacaagtatgtacataccaagagtcaaacctacaaagatgtgtgagaatgtgagtaccagtgctgtagtcatgagtgctcttataagtactcaattcttatgttaaggggttgctagtgactacgatagcctactcacactcttcaagtgagcgatttcgacttcaaattgactcggactcagcaagtcacgctgttcataacagggcgaagtttcgttcatggtgctcaagagcgcgagagttcttgcggtttgagacgatagtttcgtgctgtataacacccaatcccacttgttttagcttgttgattctgaaaacaactggttagtcgtcttcaagagtcgcgacgtctttagcgtctggacgaattcggaatccgcgtacttatttgattagaacattgagccttgagttggtaatcttctacaagatgaggtgtttgcattcgccgtaagctcggaaaagcacttcttcagccctgctggtctccattagctgcttctacggtactgttacttgtataactgcattcacctccatcccttgaacctaacacgcttgcttgtcatcagacccgagagtataatctattagtagagcagagtggtgtgctatcgtgtgctataactgctttattcaagctgtgttaggggttgtatgtgggcttgcttttgaaagtacaagtaatgcttgtgcgtaccaacactgctgtcagaaagaactagagagaagagaagctgctctttcaagttccgtcggtgcgggtgccgtatgtactctacttgtactagaacaggcattcacaaagagctgtttgtatggaatggctatcatatatcaaatatatatcgtacagaatgtgcttgtactccttctacataaaatgtacttgtactgattctgctggttaaacggacggtgtatgccgaaccgaccaatccataattcaacagctgtattttatgagaagaaagacaatccagacggccccattacaagtacttgtactcgtaacaagacagtcctccccataccatcttttatatgccacatgccccgccttggtttctctgttagctccactaacagatttcatgtgcctggccttcatgggccatctggagtgagttgacagcagtcaagttccatatcataatgtctaaccatagagcatatttagcctgagagtccatcgcattatagctcaaacctgctctgcaatactgagtcagctcttcccctattaatcaaatctaatgaggataaggctcgaagctcggatcctatttttacgatcatcatcagagtttgaaaagacaggtttcaaatccacattagtcaagcacaagtgggtcacggtgccgcatccatgctggattgcaccatagcgcagtttccatacatggaagagtgacacagtggcggtggcgatcgggtgcatcaaaacaaggtgaaacgccgttttttgccgtggatagacataagcaggctacctgagtatatgtggtgttgagacagatacacttcggcaattttttttttttttcacccttctcattttcgttttcattccccatgcacattttgcaatttccattttcactgttttgacaacgttgcagtcaaagctaaagagtcagagagacaaacagatacatagcagagataaatgcaacgttggggtggtatcgagcggaaaacttcgcagaataaaatcctggagttgtttcacgtttacaaagggtaatatattgaccaagtggtcaccttactgctctgctcgccattatcccttattctatgctccatattttaggatgcatctctcgaggtaaacgcactcaagtttttccctctcacctcagctgtagaagcatagtggctacaatacgggagggtccctgacagcgttatatatagacaaagtgctccctttgaaaacacaaaccgacagcctatatcactcacacaacacacacgagtacgtgccttttacagccacgcctcccccgttcaagcgctcaaatccacccttctcttactcgcacgtacgttgtgtggaagcttgtgagcggataacaatttcacacaggaaacagctatgaccatgattacgccaagctcgaaattaaccctcactaaagggaacaaaagctggagctccaccgcggacacaatatctggtcaaatttcagtttcgttacatttaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatacgctctcatcaagaatacttcttgagaaccgtggagaccggggttcgattccccgtatcggagtgtttattttttgctcaaccataccctggggtgtgttctgtggagcattctcacttttggtaaacgacattgcttcaagtgcagcggaatcaaaaagtataaagtgggcagcgagtatacctgtacagactgtaggcgataactcaatccaattaccccccacaacatgactggccaaactgatctcaagactttattgaaatcagcaacaccgattctcaatgaaggcacatacttcttctgcaacattcacttgacgcctaaagttggtgagaaatggaccgacaagacatattctgctatccacggactgttgcctgtgtcggtggctacaatacgtgagtcagaagggctgacggtggtggttcccaaggaaaaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagaattcaagatactatcaagacatgtgtcgcaacttaattaactctctggtgcttgactatggctgatcggacgggaagccgtattttcaccaggatatggccgtaaccaaacctccgcaacggagaattgaactccggtcccccgcgtgctgaacagaggttctgacaggcggaaattctagccactaaactattgcggattttagtttgaaccttatgtaaattaaaaaatagtgacatacaaatcacgtgattaaataaactttaaaacctagaaacaaagaattccattgtcatgctgtaattaaaatgagtattttaacccccactctctgtcaaattgctctaacatgttacgtgtgggtacggtgtaattatttctgtgctggcgatgaccattcttgtagttgcaatttgcaattacgtgcgatcaaaaatctcaaaaaatcgacacaatacgatcggctgattaatcacttgattcttacatcaagaccgatatgaccactacttgtagtagcgaccacaagaactacaagtacttgtacaagtaatacctttttacttgtacttactcgtgattagttgcacaagttcgtacgtacaagcacgacgattacaatgtcatggaaatggtacaattcattacatacactcttgaatatcgttacagggagcggaataaggctacaagtagacagctttctcgcccatataggtgacccaaaacagctcacaagtcctctaaaaacgctcagatggacatgagagatccgataaaggtcaggatcagtcgagatcggacctcgacgatatcctcgggaaccagccagatcagtgcgcccaactttcgggcgatagagattgccagcttggcgttgaggtactgatcctcaggagtgtcaccgggcgtaacgaggtcgtagtcaacgtaaccaggcttgagaccattgagcacgtccagcaggaagtgaccattggccaacgacgagtccttaaaggatcgcacggtagagctcttgccacccttctggacctggccctgggcccacttgagcatgtccgaatcggacacttcctttccgccctgcgacaaacttgccagagtcagcacaatgtttcgtcgcatcagctgccacaccagacccagggtcagagtcttctggccctccgtaatgtcgtttccttcgattccaaccagtgagaacttgttggcttttccaatctccacggcgtagttggtgttctccacggccttgaaggtcatgagctcatttccgttagcaggacgcttgttaacaaacttccagttgacagatccgggaataaccttgtcgtacgcctgcagcagcacgtttccgtccttgaggtcctcgaacagcgagacgacggggggatccacatcgagtgaattaagccacaaggtgaagactcgagcctctcgctcgccctcggcgtcaaagtcttcgatatccaccttctcgttctcctccagggggtccagaccgggccaggtgttgaacagatgggcaacaaaggccaggttaagcttggggtttccagaaaccagtgcggagggagacaggtactttctgcacccaatcttgtcggcgttggtgagaatctcctcggctcgctggagcagatcctgggtctgaagaggagctcgagagcactcttcgggtttcaactggttcatgagaattgtgtagttctcaccgtcacaaacgtccttggagaagttgttgacccgtcggttccagccagcagccttgaggtggtagttgaaccatcgcaggcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgg

SEQ ID NO: 78 - DNA, 8080 bp, Artificial Sequence
  Plasmid pYRH54
taattactcgagagtattgagctgcttggcaagatccttgacggactcctccagagtatggtacttaagcccgctctgcttgttggtcagagagttgtcgtacttgggaatggtagagtgaagagggacccccgatccaggctctcccacaggaatcttgcccttgaactcgtccatctcattaagcacgtccagcacgtcctgcggagtgaagatgcctcccactgtgtaccatctggagtttgcagactcctcgggtcgctccagagctctaatgtgtccctcggccacgtctcgcacgtccacccagtaagtaggaccggcctttccaatggtgctggacttgatgatgtcccacacaatcttgttggaggtgttgagggtggcagcggaaacgtcgtgcttcatgggtccaaacacgtaaggagggttgatggccgtgagacggaacttggggttcttttccttctggaagttccacatggcctcctcggcaaactgcttggaagccttgtatgtcgaggcggggttgttgatggcctcctcccagggcacgttggaccagcacttttcggtgtacacggtctccgggtccttatgtcgggcgtcgtagtatgtgatggcggcgttggaggaggtgattaccacgtgttcgacgccaggtccgtgctcctgcgcagcctccagaatgcctcgggtgccgttgatggcgggatccagaatctccttctggggatccttggggttgaggaagaagggcgaggcggtgtgcagaatgtgggtgatcttgtggttcttgagggcattgttgaaggcgtccttctgggccacgtccggcacaatctcaaacttgaggtcgtgaccagggtacttttcagcaaggaacttggccttgttgtcggatcgcactgtggtgacgacaggaatgccccgcttgacgagtccgtcgagaatgtgggcggcaatgaatccggagccgccggtgagaagaacgagcatttttgaaagaattgacgttgtaaaaatggaggacagaagacctgtcaatatcggataaactaaacggcacttgatgcgcttgtatcatgtaccttttgagtttgggttggctgggctgaagatatgagataacggaggagaataaaactgtgtactgtaagttgcactttcatattatatccattataattgaaacatgaggagaatgggagtataatggtgttgtttttattgccttgagacttctacttgtcttgttatagccccccttgttgcctcctccgaaactcaatcaagcttggcgaactggccaacagaggaaacacacgatataagtatgtacgagcacttgtacggtatattagatggatatcctgagagctctgatcgaactttacacgattgattccacaaaactcatgaatacttctccactcttgtgtcatagagagattgtagaaaacacccaacggctttcttacagtgtgtatgtactgtgctcaactacttgtacagtcttgttttacagctgaaaatgacttgccgttaggatctacaagtatattcattcaggttcattgcaatatttccatctcctacttgttcaataagtacttgtacttgtacaaatactcttttcttttcttcctcttccactctccctcgttcctgattcacacccatcggcacttcactctccatgcggctattctcttacagcgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccacgtacatgtacatactgtagggggtccaggtgtcatcgcgttagcgagacatttgattagtcgagttgaaccaagacgacgttttggggatattattagtcggaacttgtcggtctaaaagcgtccgttctttcaatgacaatactacggtacgtgatatgccattcctacaagtgtgcaatactatcgtagctactgtaccgtactgtagctaaccgacgatacccttcaattgttggtgcttgttttataccctcgtatgtacagtacatacgagcgctcgtactatgctgtatcgtatcgtcccggatggttctttccagcagtagtacgagacattcaaaagaaatgtcgcattttaacacgtgattaaacgccactgagccggtcacagacgcccgaaatcggctcattaaacacctcaaatggcacgtttgtttttactgatttaaccaattttttcgctcttcaccacagatgaatgatgtcactctcccttgggtttttgcttttagattgccttaggtccctctcaccaggtgcactcgaagttaaccaccaacctagacaaggcacacgatagggacgataccccaactacagtacaagtacagtagcggcgcaagcacttgtaaccagaattagcagctgccctaaacgacgaagggcccttcccttcctattccagtcgccctaaccctgcccaaccgaaccaccccatgcattcttatcgcgcctacccgtgctatctcctctttgctcttctgtcgctctcttcattcctgtctctgtagccgcatgacagccggtttcagttgagaactgtatgtatgtacagcagagggaggtgtagatggccctatcgagcttgtagtggcgattatgagaccaccgctaaagctacggcgtattatccagggtgtctgtcgagacacagcagagtgcacgtgcggctatcgacctccatgtggccacgtactccgtacagcgtgtagtcggatgtactacttgtacatggtacaggacgtaccggtactcgtacgttgtgtggaagcttgtgagcggataacaatttcacacaggaaacagctatgaccatgattacgccaagctcgaaattaaccctcactaaagggaacaaaagctggagctccaccgcggacacaatatctggtcaaatttcagtttcgttacatttaaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatacgctctcatcaagaatacttcttgagaaccgtggagaccggggttcgattccccgtatcggagtgtttattttttgctcaaccataccctggggtgtgttctgtggagcattctcacttttggtaaacgacattgcttcaagtgcagcggaatcaaaaagtataaagtgggcagcgagtatacctgtacagactgtaggcgataactcaatccaattaccccccacaacatgactggccaaactgatctcaagactttattgaaatcagcaacaccgattctcaatgaaggcacatacttcttctgcaacattcacttgacgcctaaagttggtgagaaatggaccgacaagacatattctgctatccacggactgttgcctgtgtcggtggctacaatacgtgagtcagaagggctgacggtggtggttcccaaggaaaaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagaattcaagatactatcaagacatgtgtcgcaacttaat

SEQ ID NO: 79 - DNA, 2542 bp, Yarrowia lipolytica
ctgtagtagcgtattgttgtggtgtatcgtatcggttaaggggtgtcgtggataagaatgcactgtggggaagagttgtttaatgaagtgcatgtaatcagctgatggagttgaaaaaggcaaaagacattgtgagtaacagtgtttgttctgggtaccaatgtgtatctaagagagattgttggtttggtccccagattccaacccagctagacctttcaccaacaacttaccaaagtattagacagccgacccaatcgttaccgatagctcgctattgctgcgtttagcgctcttatcgcttttaccttcgaggcgtatcggaacttaatatgcgtgggggtagcagtaggaagctcgactggtatgtgtattggtatactgtttctactgtagtgatatttgaagatgatggtttgtaccaattcaattgcaaatacaagatacttcagtcgttgcacaatttcgggatctgtaatgaccatatcagtacatacaagtatgtacataccaagagtcaaacctacaaagatgtgtgagaatgtgagtaccagtgctgtagtcatgagtgctcttataagtactcaattcttatgttaaggggttgctagtgactacgatagcctactcacactcttcaagtgagcgatttcgacttcaaattgactcggactcagcaagtcacgctgttcataacagggcgaagtttcgttcatggtgctcaagagcgcgagagttcttgcggtttgagacgatagtttcgtgctgtataacacccaatcccacttgttttagcttgttgattctgaaaacaactggttagtcgtcttcaagagtcgcgacgtctttagcgtctggacgaattcggaatccgcgtacttatttgattagaacattgagccttgagttggtaatcttctacaagatgaggtgtttgcattcgccgtaagctcggaaaagcacttcttcagccctgctggtctccattagctgcttctacggtactgttacttgtataactgcattcacctccatcccttgaacctaacacgcttgcttgtcatcagacccgagagtataatctattagtagagcagagtggtgtgctatcgtgtgctataactgctttattcaagctgtgttaggggttgtatgtgggcttgcttttgaaagtacaagtaatgcttgtgcgtaccaacactgctgtcagaaagaactagagagaagagaagctgctctttcaagttccgtcggtgcgggtgccgtatgtactctacttgtactagaacaggcattcacaaagagctgtttgtatggaatggctatcatatatcaaatatatatcgtacagaatgtgcttgtactccttctacataaaatgtacttgtactgattctgctggttaaacggacggtgtatgccgaaccgaccaatccataattcaacagctgtattttatgagaagaaagacaatccagacggccccattacaagtacttgtactcgtaacaagacagtcctccccataccatcttttatatgccacatgccccgccttggtttctctgttagctccactaacagatttcatgtgcctggccttcatgggccatctggagtgagttgacagcagtcaagttccatatcataatgtctaaccatagagcatatttagcctgagagtccatcgcattatagctcaaacctgctctgcaatactgagtcagctcttcccctattaatcaaatctaatgaggataaggctcgaagctcggatcctatttttacgatcatcatcagagtttgaaaagacaggtttcaaatccacattagtcaagcacaagtgggtcacggtgccgcatccatgctggattgcaccatagcgcagtttccatacatggaagagtgacacagtggcggtggcgatcgggtgcatcaaaacaaggtgaaacgccgttttttgccgtggatagacataagcaggctacctgagtatatgtggtgttgagacagatacacttcggcaattttttttttttttcacccttctcattttcgttttcattccccatgcacattttgcaatttccattttcactgttttgacaacgttgcagtcaaagctaaagagtcagagagacaaacagatacatagcagagataaatgcaacgttggggtggtatcgagcggaaaacttcgcagaataaaatcctggagttgtttcacgtttacaaagggtaatatattgaccaagtggtcaccttactgctctgctcgccattatcccttattctatgctccatattttaggatgcatctctcgaggtaaacgcactcaagtttttccctctcacctcagctgtagaagcatagtggctacaatacgggagggtccctgacagcgttatatatagacaaagtgctccctttgaaaacacaaaccgacagcctatatcactcacacaacacacacgagtacgtgccttttacagccacgcctcccccgttcaagcgctcaaatccacccttctcttactcgca

SEQ ID NO: 80 - DNA, 1757 bp, Yarrowia lipolytica
ctctctggtgcttgactatggctgatcggacgggaagccgtattttcaccaggatatggccgtaaccaaacctccgcaacggagaattgaactccggtcccccgcgtgctgaacagaggttctgacaggcggaaattctagccactaaactattgcggattttagtttgaaccttatgtaaattaaaaaatagtgacatacaaatcacgtgattaaataaactttaaaacctagaaacaaagaattccattgtcatgctgtaattaaaatgagtattttaacccccactctctgtcaaattgctctaacatgttacgtgtgggtacggtgtaattatttctgtgctggcgatgaccattcttgtagttgcaatttgcaattacgtgcgatcaaaaatctcaaaaaatcgacacaatacgatcggctgattaatcacttgattcttacatcaagaccgatatgaccactacttgtagtagcgaccacaagaactacaagtacttgtacaagtaatacctttttacttgtacttactcgtgattagttgcacaagttcgtacgtacaagcacgacgattacaatgtcatggaaatggtacaattcattacatacactcttgaatatcgttacagggagcggaataaggctacaagtagacagctttctcgcccatataggtgacccaaaacagctcacaagtcctctaaaaacgctcagatggacatgagagatccgataaaggtcaggatcagtcgagatcggacctcgacgatatcctcgggaaccagccagatcagtgcgcccaactttcgggcgatagagattgccagcttggcgttgaggtactgatcctcaggagtgtcaccgggcgtaacgaggtcgtagtcaacgtaaccaggcttgagaccattgagcacgtccagcaggaagtgaccattggccaacgacgagtccttaaaggatcgcacggtagagctcttgccacccttctggacctggccctgggcccacttgagcatgtccgaatcggacacttcctttccgccctgcgacaaacttgccagagtcagcacaatgtttcgtcgcatcagctgccacaccagacccagggtcagagtcttctggccctccgtaatgtcgtttccttcgattccaaccagtgagaacttgttggcttttccaatctccacggcgtagttggtgttctccacggccttgaaggtcatgagctcatttccgttagcaggacgcttgttaacaaacttccagttgacagatccgggaataaccttgtcgtacgcctgcagcagcacgtttccgtccttgaggtcctcgaacagcgagacgacggggggatccacatcgagtgaattaagccacaaggtgaagactcgagcctctcgctcgccctcggcgtcaaagtcttcgatatccaccttctcgttctcctccagggggtccagaccgggccaggtgttgaacagatgggcaacaaaggccaggttaagcttggggtttccagaaaccagtgcggagggagacaggtactttctgcacccaatcttgtcggcgttggtgagaatctcctcggctcgctggagcagatcctgggtctgaagaggagctcgagagcactcttcgggtttcaactggttcatgagaattgtgtagttctcaccgtcacaaacgtccttggagaagttgttgacccgtcggttccagccagcagccttgaggtggtagttgaaccatcgcag

SEQ ID NO: 81 - DNA, 1038 bp, Yarrowia lipolytica
acgtacatgtacatactgtagggggtccaggtgtcatcgcgttagcgagacatttgattagtcgagttgaaccaagacgacgttttggggatattattagtcggaacttgtcggtctaaaagcgtccgttctttcaatgacaatactacggtacgtgatatgccattcctacaagtgtgcaatactatcgtagctactgtaccgtactgtagctaaccgacgatacccttcaattgttggtgcttgttttataccctcgtatgtacagtacatacgagcgctcgtactatgctgtatcgtatcgtcccggatggttctttccagcagtagtacgagacattcaaaagaaatgtcgcattttaacacgtgattaaacgccactgagccggtcacagacgcccgaaatcggctcattaaacacctcaaatggcacgtttgtttttactgatttaaccaattttttcgctcttcaccacagatgaatgatgtcactctcccttgggtttttgcttttagattgccttaggtccctctcaccaggtgcactcgaagttaaccaccaacctagacaaggcacacgatagggacgataccccaactacagtacaagtacagtagcggcgcaagcacttgtaaccagaattagcagctgccctaaacgacgaagggcccttcccttcctattccagtcgccctaaccctgcccaaccgaaccaccccatgcattcttatcgcgcctacccgtgctatctcctctttgctcttctgtcgctctcttcattcctgtctctgtagccgcatgacagccggtttcagttgagaactgtatgtatgtacagcagagggaggtgtagatggccctatcgagcttgtagtggcgattatgagaccaccgctaaagctacggcgtattatccagggtgtctgtcgagacacagcagagtgcacgtgcggctatcgacctccatgtggccacgtactccgtacagcgtgtagtcggatgtactacttgtacatggtacaggacgtaccggtact

SEQ ID NO: 82 - DNA, 1717 bp, Yarrowia lipolytica
ttactcgagagtattgagctgcttggcaagatccttgacggactcctccagagtatggtacttaagcccgctctgcttgttggtcagagagttgtcgtacttgggaatggtagagtgaagagggacccccgatccaggctctcccacaggaatcttgcccttgaactcgtccatctcattaagcacgtccagcacgtcctgcggagtgaagatgcctcccactgtgtaccatctggagtttgcagactcctcgggtcgctccagagctctaatgtgtccctcggccacgtctcgcacgtccacccagtaagtaggaccggcctttccaatggtgctggacttgatgatgtcccacacaatcttgttggaggtgttgagggtggcagcggaaacgtcgtgcttcatgggtccaaacacgtaaggagggttgatggccgtgagacggaacttggggttcttttccttctggaagttccacatggcctcctcggcaaactgcttggaagccttgtatgtcgaggcggggttgttgatggcctcctcccagggcacgttggaccagcacttttcggtgtacacggtctccgggtccttatgtcgggcgtcgtagtatgtgatggcggcgttggaggaggtgattaccacgtgttcgacgccaggtccgtgctcctgcgcagcctccagaatgcctcgggtgccgttgatggcgggatccagaatctccttctggggatccttggggttgaggaagaagggcgaggcggtgtgcagaatgtgggtgatcttgtggttcttgagggcattgttgaaggcgtccttctgggccacgtccggcacaatctcaaacttgaggtcgtgaccagggtacttttcagcaaggaacttggccttgttgtcggatcgcactgtggtgacgacaggaatgccccgcttgacgagtccgtcgagaatgtgggcggcaatgaatccggagccgccggtgagaagaacgagcatttttgaaagaattgacgttgtaaaaatggaggacagaagacctgtcaatatcggataaactaaacggcacttgatgcgcttgtatcatgtaccttttgagtttgggttggctgggctgaagatatgagataacggaggagaataaaactgtgtactgtaagttgcactttcatattatatccattataattgaaacatgaggagaatgggagtataatggtgttgtttttattgccttgagacttctacttgtcttgttatagccccccttgttgcctcctccgaaactcaatcaagcttggcgaactggccaacagaggaaacacacgatataagtatgtacgagcacttgtacggtatattagatggatatcctgagagctctgatcgaactttacacgattgattccacaaaactcatgaatacttctccactcttgtgtcatagagagattgtagaaaacacccaacggctttcttacagtgtgtatgtactgtgctcaactacttgtacagtcttgttttacagctgaaaatgacttgccgttaggatctacaagtatattcattcaggttcattgcaatatttccatctcctacttgttcaataagtacttgtacttgtacaaatactcttttcttttcttcctcttccactctccctcgttcctgattcacacccatcggcacttcactctccatgcggctattctcttacagc

SEQ ID NO: 83 - DNA, 20 bp, Artificial Sequence
  Primer ELM1-1406F
aggatctggcagaggcgttt

SEQ ID NO: 84 - DNA, 18 bp, Artificial Sequence
  Primer ELM1-1467R
atggtccacgccctcgtt

SEQ ID NO: 85 - DNA, 18 bp, Artificial Sequence
  Primer SAK1-210F
gaccacgggcgagtacgt

SEQ ID NO: 86 - DNA, 19 bp, Artificial Sequence
  Primer SAK1-272R
ttgccgagcttgggttttc

SEQ ID NO: 87 - DNA, 18 bp, Artificial Sequence
  Nucleotide portion of primer ELM1-1431T
aattgcggccgacagcgc

SEQ ID NO: 88 - DNA, 21 bp, Artificial Sequence
  Nucleotide portion of primer SAK1-231T
catcaaggtcgtggatcgcct

SEQ ID NO: 89 - DNA, 9194 bp, Artificial Sequence
  Plasmid pYRH44
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgtacaactttgctttgaaacgatcacggtccatgggattcgacgactcccatcgaccggctgaaatgataaaggagcgagaagaagaagaggccaggctggcgctggaacgagcctctctcaacaacaccaacaacactgccccgactacccaaagtaacgaccaggcttcgtcgataagctctgcagaagacgatacagacacccacgaaatcagctctgtgtcgtcgcctgagctggaggccacagacccatctaaatccgctgtgaccacctccgcagagcctccagcggccccggttcacgatgactcggacgtgcactacgagccgtcgcgacacgtggactatctgtcccatgactggaaggagtcggacatttcgtcgtcgtggcgctatattgtgctgcgtcgaaaggaggtggccaactcggcccggctggaaaatgcgtcgtggcgaacctgggccaaggccaaatacaacctgaagactgtgtcgcccgagagtgttaactggctcaaggactacgacgtcacatggctgtacgggcccctttgccggacctcttcgcaggccaacatttccggcgttggaggagctgctgctggagatgcgaccccgaccgcctcttccgacaaggaggagcagggagctactgcgggagacacaaagtcgattctcaagaaacgaagcgcaacagagatgattctggcacttccaccaatgcgtcggtccaaggacgactccgcggtgacccccgctgcaattgcggctgctggagacgacaaagacaaggtggtcaagtcgtatttccgccaccatcagtaccgacagaagaacccttatggcatgactgatgaggaggtcgacactctggccgacaagctcaacgcccaatacaagctgcctcccaaaagcaagtccgctggagagggtgaagatggtaccactacaccctcttcggtgaccccctcggccacaccttctagagacgagttggtggcgcctcctcccactgctaacaaggataatgtcttggaagaagacgaggctgccacgcctattgctacagtggcccctccccccacgaagcccaagcgtcgcatccacttcaactcggaggtccagcaatgcatttctctggactacgtatcatctgacgaggaagaccagtacgactcggattcggattctgacgattccgactcggacgagctcgacgaggaggacgacgaacctggtctgtttctcatggtgcgatcttcgtcctcggcatctatgcatcgacccgagttgtccggtatggcccggaacgagcagcctggttccggtggaagaagaggctctaatgaagacctttcagacgactctgataacgacgttgagacggaccctctcaaggcagtgcgaacaattgcacccattcctcccacctcgttgaagtatgcatatgacgaggatcccatggatgctgagtgtaatgccattgcaaccgtgcactccgctgtgtcgcacaacaattcgcgacgacgagactacgcacactacgattacaactcagtgtaccaagccccagtcaacaagcatcaagccaatgaaagcatcatccccaaggccccatatatggagtcgccttccaactcgctgactcctagccccacaggttctcccgagggctctcccaaaccaaagtacatggacatcttggagcaggtgcgacaggcccaggctgctttggcagcccaacccatagaggttcgaacccaggagactgacaagaacattgtgggtactgtttctgaggtggcaacgttggacggactgatttccgactcggatgatcaccatgatcatgatgagctcgctgctcttcatgaccattattctgatgacgacagcaaaccaactgagcttgcttctgaagcctctgagcctgctgagtcttccgaaactttctccaagggcgtgagctctccgaaacggtccattgccaccacggcaaccccaaccaccagtacgtcgactgaaaatgtgtctgggctgattgacgagaaggaagaccgaccaaaggcgttccgaagccctagtacagactccacatcaagcacggggtcggggtccagtgagaaacggttgattgacaaggccaaggatatggccagtaatctgtggggctggggatctgccagcagtggcaactaggc

SEQ ID NO: 90 - DNA, 2202 bp, Yarrowia lipolytica
  CDS (1)..(2202): Locus YALI0B16808g within public Y. lipolytica protein database of the "Yeast project Genolevures" (Center for Bioinformatics, LaBRI, Talence Cedex, France); Reg1p
atggacaactttgctttgaaacgatcacggtccatgggattcgacgactcccatcgaccggctgaaatgataaaggagcgagaagaagaagaggccaggctggcgctggaacgagcctctctcaacaacaccaacaacactgccccgactacccaaagtaacgaccaggcttcgtcgataagctctgcagaagacgatacagacacccacgaaatcagctctgtgtcgtcgcctgagctggaggccacagacccatctaaatccgctgtgaccacctccgcagagcctccagcggccccggttcacgatgactcggacgtgcactacgagccgtcgcgacacgtggactatctgtcccatgactggaaggagtcggacatttcgtcgtcgtggcgctatattgtgctgcgtcgaaaggaggtggccaactcggcccggctggaaaatgcgtcgtggcgaacctgggccaaggccaaatacaacctgaagactgtgtcgcccgagagtgttaactggctcaaggactacgacgtcacatggctgtacgggcccctttgccggacctcttcgcaggccaacatttccggcgttggaggagctgctgctggagatgcgaccccgaccgcctcttccgacaaggaggagcagggagctactgcgggagacacaaagtcgattctcaagaaacgaagcgcaacagagatgattctggcacttccaccaatgcgtcggtccaaggacgactccgcggtgacccccgctgcaattgcggctgctggagacgacaaagacaaggtggtcaagtcgtatttccgccaccatcagtaccgacagaagaacccttatggcatgactgatgaggaggtcgacactctggccgacaagctcaacgcccaatacaagctgcctcccaaaagcaagtccgctggagagggtgaagatggtaccactacaccctcttcggtgaccccctcggccacaccttctagagacgagttggtggcgcctcctcccactgctaacaaggataatgtcttggaagaagacgaggctgccacgcctattgctacagtggcccctccccccacgaagcccaagcgtcgcatccacttcaactcggaggtccagcaatgcatttctctggactacgtatcatctgacgaggaagaccagtacgactcggattcggattctgacgattccgactcggacgagctcgacgaggaggacgacgaacctggtctgtttctcatggtgcgatcttcgtcctcggcatctatgcatcgacccgagttgtccggtatggcccggaacgagcagcctggttccggtggaagaagaggctctaatgaagacctttcagacgactctgataacgacgttgagacggaccctctcaaggcagtgcgaacaattgcacccattcctcccacctcgttgaagtatgcatatgacgaggatcccatggatgctgagtgtaatgccattgcaaccgtgcactccgctgtgtcgcacaacaattcgcgacgacgagactacgcacactacgattacaactcagtgtaccaagccccagtcaacaagcatcaagccaatgaaagcatcatccccaaggccccatatatggagtcgccttccaactcgctgactcctagccccacaggttctcccgagggctctcccaaaccaaagtacatggacatcttggagcaggtgcgacaggcccaggctgctttggcagcccaacccatagaggttcgaacccaggagactgacaagaacattgtgggtactgtttctgaggtggcaacgttggacggactgatttccgactcggatgatcaccatgatcatgatgagctcgctgctcttcatgaccattattctgatgacgacagcaaaccaactgagcttgcttctgaagcctctgagcctgctgagtcttccgaaactttctccaagggcgtgagctctccgaaacggtccattgccaccacggcaaccccaaccaccagtacgtcgactgaaaatgtgtctgggctgattgacgagaaggaagaccgaccaaaggcgttccgaagccctagtacagactccacatcaagcacggggtcggggtccagtgagaaacggttgattgacaaggccaaggatatggccagtaatctgtggggctggggatctgccagcagtggcaactag

SEQ ID NO: 91 - protein, 733 aa, Yarrowia lipolytica
MDNFALKRSRSMGFDDSHRPAEMIKEREEEEARLALERASLNNTNNTAPTTQSNDQASSISSAEDDTDTHEISSVSSPELEATDPSKSAVTTSAEPPAAPVHDDSDVHYEPSRHVDYLSHDWKESDISSSWRYIVLRRKEVANSARLENASWRTWAKAKYNLKTVSPESVNWLKDYDVTWLYGPLCRTSSQANISGVGGAAAGDATPTASSDKEEQGATAGDTKSILKKRSATEMILALPPMRRSKDDSAVTPAAIAAAGDDKDKVVKSYFRHHQYRQKNPYGMTDEEVDTLADKLNAQYKLPPKSKSAGEGEDGTTTPSSVTPSATPSRDELVAPPPTANKDNVLEEDEAATPIATVAPPPTKPKRRIHFNSEVQQCISLDYVSSDEEDQYDSDSDSDDSDSDELDEEDDEPGLFLMVRSSSSASMHRPELSGMARNEQPGSGGRRGSNEDLSDDSDNDVETDPLKAVRTIAPIPPTSLKYAYDEDPMDAECNAIATVHSAVSHNNSRRRDYAHYDYNSVYQAPVNKHQANESIIPKAPYMESPSNSLTPSPTGSPEGSPKPKYMDILEQVRQAQAALAAQPIEVRTQETDKNIVGTVSEVATLDGLISDSDDHHDHDELAALHDHYSDDDSKPTELASEASEPAESSETFSKGVSSPKRSIATTATPTTSTSTENVSGLIDEKEDRPKAFRSPSTDSTSSTGSGSSEKRLIDKAKDMASNLWGWGSASSGN

SEQ ID NO: 92 - DNA, 8357 bp, Artificial Sequence
  Plasmid pZUFmEaD5S
catggccaccatctccctgactaccgagcagctcctggaacaccccgagctcgttgccatcgacggagtcctgtacgatctcttcggtctggccaaggtgcatccaggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 93 - DNA, 40 bp, Artificial Sequence
  Primer REG1-F
gatcaaacatgtacaactttgctttgaaacgatcacggtc

SEQ ID NO: 94 - DNA, 38 bp, Artificial Sequence
  Primer REG1-R
gatcaagcggccgcctagttgccactgctggcagatcc

SEQ ID NO: 95 - DNA, 9033 bp, Artificial Sequence
  Plasmid pYRH45
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgtttcatcttggtccccgaaaacccccgtcccgaaaggtgagtatgattgcacattagggggatgagcgattagcgacatgcaaagacaacatggcatagcggtattacagggagctccacagatacacggttctggcgaaaacagatacacggctccgatggtgcaaggacgtgatagtaaacagacgtccaagtcgtcgccttggaacatgacgagtcataccctcacacaaccaccctgtcacgtccagcacgccgtcggacatgacttccgtctgtgttgattcacagccattgtgagggatgtgattggtgctgcgacatggaaggaaaggtgactgtctaccgttgccaccggtttggttctgtacacgttcggtgtccaagtaatagccaccttgtcacatgctgttgcctgcaggatgttgtcttcgctcgccagaaaaggcaactcgcagccatactaacacagggctcaatggcagacgtcccgcgggacctgctggagcaaatctcccagcttgaaaccatcttcaccgtttcgcccgaaaagctgcgtcaaatcaccgaccactttgtgtccgagctcgctaaaggcctcacaaaggagggtggagatatccccatgaaccccacctggattctgggatggcccaccggaaaggagagcggctgctatctggctctcgacatgggtggcaccaacctgcgagttgtcaaggtgactctggacggcgaccgaggcttcgacgtcatgcagtccaagtaccacatgccccccaacatcaaggtcggcaagcaagaggagctgtgggagtacattgccgaatgtctgggcaagttcttggccgacaattatcctgaggctcttgatgcccatgagcgaggacgagatgtcgacagaaccgctgcgcagagcttcactcgagacaagtctcctcctccccacaaccagcacatttcgtgttctcctggcttcgacatccacaagattcctctcggtttcaccttttcatatccctgctctcagcccgccgtcaaccgaggtgtactgcagcgatggaccaagggtttcgacattgagggagtcgagggcgaggacgtggtccccatgctggaagctgccctcgaaagaaagaacattcctatttccatcaccgccctgatcaacgacaccaccggaactatggtggcctccaactaccacgacccccagatcaagctgggtaacatctttggtactggtgtcaacgccgcctactacgagaaggtcaaggacattcccaagctcaagggtctcatccccgacagcattgatcccgagacccccatggccgtcaattgcgagtatggagccttcgacaatgagcacaaggttctccctagaaccaagtgggacatcatcatcgatgaggagtctccccgacccggtcagcagaccttcgagaagatgagtgctggctactacctgggagaattgcttcgtctggttcttctggacctgtacaaggacgggtttgtgttcgagaaccagggcaagaacggtcaggagcttggaaacggcaacatcaacaagtcgtatttcttcgacacctctttcctgtctctgattgaggaggatccctgggagaacttgactgatgtcgagattctcttcaaggagaagcttggtattaacaccactgagcccgagcgaaagctcattcgtcgactggccgagctcattggtactcgatccgctcgaatctctgcctgtggtgtcgctgccatctgtaagaaggctggctacaaggaggctcacgctggagctgacggatccgtgttcaacaagtaccccggattcaaggagcgaggcgcccaggctctcaacgagatttttgagtggaacctgcccaaccctaaggaccaccccatcaaaatcgttcccgctgaggatggtagcggtgttggagctgctctgtgcgctgctctcaccatcaagcgagtcaagcagggtcttcccgttggtgtcaagcccggtgtcaagtacgatatttaggc

SEQ ID NO: 96 - DNA, 8387 bp, Artificial Sequence
  Plasmid pYRH46
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgtccatgggagatgacgaccgggcgtaccatcatcaaatgtctgtgattgtaaccgccgcaaacgccaaccttcccggccacggcaagggccctctggtgtcggtctcctcggagctgctgactaaagagtctcatctcatgtacgactttgagcgctacgtggctcgaaacccgtcgcgcttcaaccaaaaggttctcgacaacctccgcattcaccacacatacacccgctcgtctctggacactctggtgaacgagtttctggcagaaatcacccccgcatgcgccaacagagacgccccgtccatgctgccgtccaagatgggctcgctgcccaacgactcgctgacgggctcggtgctctccatcgacattggaggcagcactctccgtggctccatggtcgatctggagaagatgaccgtcacggactcggtccagcacctcatccccgacacggtcaagaactactcgggctcggactttttcgactggatcgtcgagcgaatcatgcctctggtcaaggactgcacagccaccatcatccccatcggcctgtcgtggtccttccccatcttccagccccacatctcctcaggcctgatccagaccatgggcaagggctacggagtggcagacgaaatcatcaaccaggacctcaaggaattgttcgagacccactttgcctctcacggcaagaccgtcgaggtcggcgccattctcaatgattcggtggcgtctctggtggcagccaactacatttccaacgctcccctgtgtctcattctcggcacaggcatcaacgtgtctgccctgatccctaaagaccagctcaagaagaccgagcaggaccaggacaagtacattgtcaactgcgaggcgtctctgtttggccagtgtgtgtccaagacgtgctgggacctggagctagaccaggctctggagcgccctggattccagcctctcgagtctctgtcttccggacgatacctcggcgaaatatgcagactgattctgcgagacttgtccaagacgggtttcttgagccgaccagacgtcgggccctacgagctgacaaccgccgaagtggctgatttggagaccgccgactcgggagagctggactacgtgcaggacatcattctggccacctccgaccggtctgccgccctggcatcggccttcattaccgccatttacaagctgactggttcggactgcgagtcgccgtccattgcctacgacggcaccatggtgcagaagtaccccaacttccgtcctcgaatgcagcagcgacttagggagcagggcctgaacgtgacatttgtggctgtggaagagggcaccgtgtatggctccgccattgcatgcgccagccagctttcacagtaggc

SEQ ID NO: 97 - DNA, 8584 bp, Artificial Sequence
  Plasmid pYRH47
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgttgattgaggtggagccagatgggctattgtttcatatatagactggcagccacctctttggcccagcatgtttgtatacctggaagggaaaactaaagaagctggctagtttagtttgattattatagtagatgtcctaatcactagagattagaatgtcttggcgatgattagtcgtcgtcccctgtatcatgtctagaccaactgtgtcatgaagttggtgctggtgttttacctgtgtactacaagtaggtgtcctagatctagtgtacagagccgtttagacccatgtggacttcaccattaacgatggaaaatgttcattatatgacagtatattacaatggacttgctccatttcttccttgcatcacatgttctccacctccatagttgatcaacacatcatagtagctaaggctgctgctctcccactacagtccaccacaagttaagtagcaccgtcagtacagctaaaagtacacgtctagtacgtttcataactagtcaagtagcccctattacagatatcagcactatcacgcacgagtttttctctgtgctatctaatcaacttgccaagtattcggagaagatacactttcttggcatcaggtatacgagggagcctatcagatgaaaaagggtatattggatccattcatatccacctacacgttgtcataatctcctcattcacgtgattcatttcgtgacactagtttctcactttcccccccgcacctatagtcaacttggcggacacgctacttgtagctgacgttgatttatagacccaatcaaagcgggttatcggtcaggtagcacttatcattcatcgttcatactacgatgagcaatctcgggcatgtccggaaaagtgtcgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccgacagcagcgactgggcaccatgatcaagcgaaacaccttcccccagctgccctggcaaaccatcaagaaccctactttcatcaagtgcaagaacggttctactcttctcacctccggtgtctacggctggtgccgaaagcctaactacaccgctgatttcatcatgtgcctcacctgggctctcatgtgcggtgttgcttctcccctgccttacttctacccggtcttcttcttcctggtgctcatccaccgagcttaccgagactttgagcgactggagcgaaagtacggtgaggactaccaggagttcaagcgacaggtcccttggatcttcatcccttatgttttctaaacgataagcttagtgagcgaatggtgaggttacttaattgagtggccagcctatgggattgtataacagacagtcaatatattactgaaaagactgaacagccagacggagtgaggttgtgagtgaatcgtagagggcggctattacagcaagtctactctacagtgtactaacacagcagagaacaaatacaggtgtgcattcggctatctgagaattagttggagagctcgagaccctcggcgataaactgctcctcggttttgtgtccatacttgtacggaccattgtaatggggcaagtcgttgagttctcgtcgtccgacgttcagagcacagaaaccaatgtaatcaatgtagcagagatggttctgcaaaagattgatttgtgcgagcaggttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgtcaatcactctgagtcagaaggttggcgagttcgcctccgagttcgccatcgatggcagctatgttcagcaaggcgtcaaacacttcgtcgatcagacagcacaggccctctcagcaaacatggaaagagcaatgcccatgattccctcgtttgtcacccgaattcccacagggaaggaaaagggtgtccagttggcagttgacctgggaggcactaacttccgggtctcatccgtgcacctgaatggtgaccacacccacaaaacggtggcatcaaaagttgctgtcagcgatgacctcatgactggcactcaagctgacttctttggatttttggcccagcaagtgaaagatttcttaacagaacaccactcagaacatttcagccagactgagcctttgcgaatgggagtgaccttctcgttccccgtcaatcaggtagctttagacaagggctatcttttgagatggaccaagggttatgatatcaaggatgctgttggaaaagacgtcgtggagctatttcagatccagctcgatgctcttgacctgaatgtgaagattgtggctctggtcaacgacaccgtgggcacactattggcgcgagcttacgcctctaaatccgacgatggtaagcataagcagaccttgatcggcgcaatctttggcaccggaaccaatggtgcttactcagaaagacttaagcgggtccccaagtttaccgctgcgaattaccctgaagttttcaagcgctactcaccagagcacatcgcgaaccaaactatgattatcaataccgagtggggatcttacgataatgacattgacgtcctcccaaacaccaaatgggatattgacttggacgaaaacactcacaacaagtcttttcacatgtttgaaaagcggatttctggaatgttcctgggtgagctgttgcggctctgtcttttggatttgaagagtgagggcctacttcttcaatccacaaagttggaaggaaaccctgtttggaagggatttggaatggacacttcggtcttgtcattcattgaagcagccactgaggcacagatcgagacaggaaagggcgactatgagaaaatcatcaaggccatgggtctggccgccaaggacatcactcctgaacaagttgctgccctgaaacccctggttacggctattggtagacgatctgcgtatctatctgccattcctttagctgccattactcttcatactcacgctttggagaaattcgacgttgttgacattggagttgacggttctgtcttccagttttaccccaaatttgctgatatggtgaaagaagcgatgggctatgtcgagggtatttctgttgaccgtatcgacatcggccacgcagaagatggctcaggggtgggagctgccttggctgcttacccggacgactcataggc

SEQ ID NO: 98 - DNA, 2041 bp, Yarrowia lipolytica
  CDS (1)..(39)
  misc_feature (1)..(2041): Locus YALI0B22308g within public Y. lipolytica protein database of the "Yeast project Genolevures" (Center for Bioinformatics, LaBRI, Talence Cedex, France); Hxk1p
  Intron (40)..(475): intron
  CDS (476)..(2038)
atggttcatcttggtccccgaaaacccccgtcccgaaaggtgagtatgattgcacattagggggatgagcgattagcgacatgcaaagacaacatggcatagcggtattacagggagctccacagatacacggttctggcgaaaacagatacacggctccgatggtgcaaggacgtgatagtaaacagacgtccaagtcgtcgccttggaacatgacgagtcataccctcacacaaccaccctgtcacgtccagcacgccgtcggacatgacttccgtctgtgttgattcacagccattgtgagggatgtgattggtgctgcgacatggaaggaaaggtgactgtctaccgttgccaccggtttggttctgtacacgttcggtgtccaagtaatagccaccttgtcacatgctgttgcctgcaggatgttgtcttcgctcgccagaaaaggcaactcgcagccatactaacacagggctcaatggcagacgtcccgcgggacctgctggagcaaatctcccagcttgaaaccatcttcaccgtttcgcccgaaaagctgcgtcaaatcaccgaccactttgtgtccgagctcgctaaaggcctcacaaaggagggtggagatatccccatgaaccccacctggattctgggatggcccaccggaaaggagagcggctgctatctggctctcgacatgggtggcaccaacctgcgagttgtcaaggtgactctggacggcgaccgaggcttcgacgtcatgcagtccaagtaccacatgccccccaacatcaaggtcggcaagcaagaggagctgtgggagtacattgccgaatgtctgggcaagttcttggccgacaattatcctgaggctcttgatgcccatgagcgaggacgagatgtcgacagaaccgctgcgcagagcttcactcgagacaagtctcctcctccccacaaccagcacatttcgtgttctcctggcttcgacatccacaagattcctctcggtttcaccttttcatatccctgctctcagcccgccgtcaaccgaggtgtactgcagcgatggaccaagggtttcgacattgagggagtcgagggcgaggacgtggtccccatgctggaagctgccctcgaaagaaagaacattcctatttccatcaccgccctgatcaacgacaccaccggaactatggtggcctccaactaccacgacccccagatcaagctgggtaacatctttggtactggtgtcaacgccgcctactacgagaaggtcaaggacattcccaagctcaagggtctcatccccgacagcattgatcccgagacccccatggccgtcaattgcgagtatggagccttcgacaatgagcacaaggttctccctagaaccaagtgggacatcatcatcgatgaggagtctccccgacccggtcagcagaccttcgagaagatgagtgctggctactacctgggagaattgcttcgtctggttcttctggacctgtacaaggacgggtttgtgttcgagaaccagggcaagaacggtcaggagcttggaaacggcaacatcaacaagtcgtatttcttcgacacctctttcctgtctctgattgaggaggatccctgggagaacttgactgatgtcgagattctcttcaaggagaagcttggtattaacaccactgagcccgagcgaaagctcattcgtcgactggccgagctcattggtactcgatccgctcgaatctctgcctgtggtgtcgctgccatctgtaagaaggctggctacaaggaggctcacgctggagctgacggatccgtgttcaacaagtaccccggattcaaggagcgaggcgcccaggctctcaacgagatttttgagtggaacctgcccaaccctaaggaccaccccatcaaaatcgttcccgctgaggatggtagcggtgttggagctgctctgtgcgctgctctcaccatcaagcgagtcaagcagggtcttcccgttggtgtcaagcccggtgtcaagtacgatatttag

SEQ ID NO: 99 - protein, 534 aa, Yarrowia lipolytica
MVHLGPRKPPSRKGSMADVPRDLLEQISQLETIFTVSPEKLRQITDHFVSELAKGLTKEGGDIPMNPTWILGWPTGKESGCYLALDMGGTNLRVVKVTLDGDRGFDVMQSKYHMPPNIKVGKQEELWEYIAECLGKFLADNYPEALDAHERGRDVDRTAAQSFTRDKSPPPHNQHISCSPGFDIHKIPLGFTFSYPCSQPAVNRGVLQRWTKGFDIEGVEGEDVVPMLEAALERKNIPISITALINDTTGTMVASNYHDPQIKLGNIFGTGVNAAYYEKVKDIPKLKGLIPDSIDPETPMAVNCEYGAFDNEHKVLPRTKWDIIIDEESPRPGQQTFEKMSAGYYLGELLRLVLLDLYKDGFVFENQGKNGQELGNGNINKSYFFDTSFLSLIEEDPWENLTDVEILFKEKLGINTTEPERKLIRRLAELIGTRSARISACGVAAICKKAGYKEAHAGADGSVFNKYPGFKERGAQALNEIFEWNLPNPKDHPIKIVPAEDGSGVGAALCAALTIKRVKQGLPVGVKPGVKYDI

SEQ ID NO: 100 - DNA, 1395 bp, Yarrowia lipolytica
  CDS (1)..(1395): Locus YALI0E20207g within public Y. lipolytica protein database of the "Yeast project Genolevures" (Center for Bioinformatics, LaBRI, Talence Cedex, France); Hxk2p
atgtccatgggagatgacgaccgggcgtaccatcatcaaatgtctgtgattgtaaccgccgcaaacgccaaccttcccggccacggcaagggccctctggtgtcggtctcctcggagctgctgactaaagagtctcatctcatgtacgactttgagcgctacgtggctcgaaacccgtcgcgcttcaaccaaaaggttctcgacaacctccgcattcaccacacatacacccgctcgtctctggacactctggtgaacgagtttctggcagaaatcacccccgcatgcgccaacagagacgccccgtccatgctgccgtccaagatgggctcgctgcccaacgactcgctgacgggctcggtgctctccatcgacattggaggcagcactctccgtggctccatggtcgatctggagaagatgaccgtcacggactcggtccagcacctcatccccgacacggtcaagaactactcgggctcggactttttcgactggatcgtcgagcgaatcatgcctctggtcaaggactgcacagccaccatcatccccatcggcctgtcgtggtccttccccatcttccagccccacatctcctcaggcctgatccagaccatgggcaagggctacggagtggcagacgaaatcatcaaccaggacctcaaggaattgttcgagacccactttgcctctcacggcaagaccgtcgaggtcggcgccattctcaatgattcggtggcgtctctggtggcagccaactacatttccaacgctcccctgtgtctcattctcggcacaggcatcaacgtgtctgccctgatccctaaagaccagctcaagaagaccgagcaggaccaggacaagtacattgtcaactgcgaggcgtctctgtttggccagtgtgtgtccaagacgtgctgggacctggagctagaccaggctctggagcgccctggattccagcctctcgagtctctgtcttccggacgatacctcggcgaaatatgcagactgattctgcgagacttgtccaagacgggtttcttgagccgaccagacgtcgggccctacgagctgacaaccgccgaagtggctgatttggagaccgccgactcgggagagctggactacgtgcaggacatcattctggccacctccgaccggtctgccgccctggcatcggccttcattaccgccatttacaagctgactggttcggactgcgagtcgccgtccattgcctacgacggcaccatggtgcagaagtaccccaacttccgtcctcgaatgcagcagcgacttagggagcagggcctgaacgtgacatttgtggctgtggaagagggcaccgtgtatggctccgccattgcatgcgccagccagctttcacagtag

SEQ ID NO: 101 - protein, 464 aa, Yarrowia lipolytica
MSMGDDDRAYHHQMSVIVTAANANLPGHGKGPLVSVSSELLTKESHLMYDFERYVARNPSRFNQKVLDNLRIHHTYTRSSLDTLVNEFLAEITPACANRDAPSMLPSKMGSLPNDSLTGSVLSIDIGGSTLRGSMVDLEKMTVTDSVQHLIPDTVKNYSGSDFFDWIVERIMPLVKDCTATIIPIGLSWSFPIFQPHISSGLIQTMGKGYGVADEIINQDLKELFETHFASHGKTVEVGAILNDSVASLVAANYISNAPLCLILGTGINVSALIPKDQLKKTEQDQDKYIVNCEASLFGQCVSKTCWDLELDQALERPGFQPLESLSSGRYLGEICRLILRDLSKTGFLSRPDVGPYELTTAEVADLETADSGELDYVQDIILATSDRSAALASAFITAIYKLTGSDCESPSIAYDGTMVQKYPNFRPRMQQRLREQGLNVTFVAVEEGTVYGSAIACASQLSQ

SEQ ID NO: 102 - DNA, 1440 bp, Yarrowia lipolytica
  CDS (1)..(1440): Locus YALI0E15488g within public Y. lipolytica protein database of the "Yeast project Genolevures" (Center for Bioinformatics, LaBRI, Talence Cedex, France); Glk1p
atgacaatcactctgagtcagaaggttggcgagttcgcctccgagttcgccatcgatggcagctatgttcagcaaggcgtcaaacacttcgtcgatcagacagcacaggccctctcagcaaacatggaaagagcaatgcccatgattccctcgtttgtcacccgaattcccacagggaaggaaaagggtgtccagttggcagttgacctgggaggcactaacttccgggtctcatccgtgcacctgaatggtgaccacacccacaaaacggtggcatcaaaagttgctgtcagcgatgacctcatgactggcactcaagctgacttctttggatttttggcccagcaagtgaaagatttcttaacagaacaccactcagaacatttcagccagactgagcctttgcgaatgggagtgaccttctcgttccccgtcaatcaggtagctttagacaagggctatcttttgagatggaccaagggttatgatatcaaggatgctgttggaaaagacgtcgtggagctatttcagatccagctcgatgctcttgacctgaatgtgaagattgtggctctggtcaacgacaccgtgggcacactattggcgcgagcttacgcctctaaatccgacgatggtaagcataagcagaccttgatcggcgcaatctttggcaccggaaccaatggtgcttactcagaaagacttaagcgggtccccaagtttaccgctgcgaattaccctgaagttttcaagcgctactcaccagagcacatcgcgaaccaaactatgattatcaataccgagtggggatcttacgataatgacattgacgtcctcccaaacaccaaatgggatattgacttggacgaaaacactcacaacaagtcttttcacatgtttgaaaagcggatttctggaatgttcctgggtgagctgttgcggctctgtcttttggatttgaagagtgagggcctacttcttcaatccacaaagttggaaggaaaccctgtttggaagggatttggaatggacacttcggtcttgtcattcattgaagcagccactgaggcacagatcgagacaggaaagggcgactatgagaaaatcatcaaggccatgggtctggccgccaaggacatcactcctgaacaagttgctgccctgaaacccctggttacggctattggtagacgatctgcgtatctatctgccattcctttagctgccattactcttcatactcacgctttggagaaattcgacgttgttgacattggagttgacggttctgtcttccagttttaccccaaatttgctgatatggtgaaagaagcgatgggctatgtcgagggtatttctgttgaccgtatcgacatcggccacgcagaagatggctcaggggtgggagctgccttggctgcttacccggacgactcatag

SEQ ID NO: 103 - protein, 479 aa, Yarrowia lipolytica
MTITLSQKVGEFASEFAIDGSYVQQGVKHFVDQTAQALSANMERAMPMIPSFVTRIPTGKEKGVQLAVDLGGTNFRVSSVHLNGDHTHKTVASKVAVSDDLMTGTQADFFGFLAQQVKDFLTEHHSEHFSQTEPLRMGVTFSFPVNQVALDKGYLLRWTKGYDIKDAVGKDVVELFQIQLDALDLNVKIVALVNDTVGTLLARAYASKSDDGKHKQTLIGAIFGTGTNGAYSERLKRVPKFTAANYPEVFKRYSPEHIANQTMIINTEWGSYDNDIDVLPNTKWDIDLDENTHNKSFHMFEKRISGMFLGELLRLCLLDLKSEGLLLQSTKLEGNPVWKGFGMDTSVLSFIEAATEAQIETGKGDYEKIIKAMGLAAKDITPEQVAALKPLVTAIGRRSAYLSAIPLAAITLHTHALEKFDVVDIGVDGSVFQFYPKFADMVKEAMGYVEGISVDRIDIGHAEDGSGVGAALAAYPDDS

SEQ ID NO: 104 - DNA, 41 bp, Artificial Sequence
  Primer HXK1-F
gatcaaacatgtttcatcttggtccccgaaaacccccgtcc

SEQ ID NO: 105 - DNA, 46 bp, Artificial Sequence
  Primer HXK1-R
gatcaagcggccgcctaaatatcgtacttgacaccgggcttgacac

SEQ ID NO: 106 - DNA, 38 bp, Artificial Sequence
  Primer HXK2-F
gatcaaacatgtccatgggagatgacgaccgggcgtac

SEQ ID NO: 107 - DNA, 46 bp, Artificial Sequence
  Primer HXK2-R
gatcaagcggccgcctactgtgaaagctggctggcgcatgcaatgg

SEQ ID NO: 108 - DNA, 38 bp, Artificial Sequence
  Primer GLK1-F
gatcaaacatgtcaatcactctgagtcagaaggttggc

SEQ ID NO: 109 - DNA, 43 bp, Artificial Sequence
  Primer GLK1-R
gatcaagcggccgcctatgagtcgtccgggtaagcagccaagg

SEQ ID NO: 110 - DNA, 8574 bp, Artificial Sequence
  Plasmid pYRH38
tacccctggtttaaacagggcattgccgagtaccttgttccacgtgacctgaagcctgatcaggtggaaatcgacgacaaggttgtgggtgctctttcagacaccatgggctacgaccgagaccaggtctacgaggctctcaaggctcctaaatccgacggaaccgaaatccgagatgcctacgacctcatgaaggagaacagacagcagttggagaaggactcgaccgtgttcgacaaggtggacgaatccggcaagcctaagcaccagttctcgcgaaagaacccgccggctctgacgtttgactcacatcacatgcccaccattgtcgaccattctgatcttcgaacccctaacacaaccattgctgttcttccctcctcgctgccagcataccatcgggccaacatgatggcccatggtcccgctaccctgcgtaagctgaatcccatctcatcgcgaaaatcaaagacccgatggcatttcggcattcggtccaagtcgtaccctctcgacgtgatgggtgagctctaccgagctctcaagaacctgggagccgagtgggcaaagccatcagagaacgacctgtggaccatcagggtgcgatggagatacacccctgaaaaggatgagtcggacagcacaactaagccagacagcggactgcttaagatgcagattcaactgtatctgctggagcagaactcgtacttggtggacttcaagtttgacggctgggagtgcgagacggagagcggtgagattaagacccgcgatgtcgcccaggtgtcgaattcaaagtccgccaacgagaccttcacgttttccgcataccccttcttgcatctggccacccggctcattatggagctggccgtgagttctcagaaggagagtgagaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgttgattgaggtggagccagatgggctattgtttcatatatagactggcagccacctctttggcccagcatgtttgtatacctggaagggaaaactaaagaagctggctagtttagtttgattattatagtagatgtcctaatcactagagattagaatgtcttggcgatgattagtcgtcgtcccctgtatcatgtctagaccaactgtgtcatgaagttggtgctggtgttttacctgtgtactacaagtaggtgtcctagatctagtgtacagagccgtttagacccatgtggacttcaccattaacgatggaaaatgttcattatatgacagtatattacaatggacttgctccatttcttccttgcatcacatgttctccacctccatagttgatcaacacatcatagtagctaaggctgctgctctcccactacagtccaccacaagttaagtagcaccgtcagtacagctaaaagtacacgtctagtacgtttcataactagtcaagtagcccctattacagatatcagcactatcacgcacgagtttttctctgtgctatctaatcaacttgccaagtattcggagaagatacactttcttggcatcaggtatacgagggagcctatcagatgaaaaagggtatattggatccattcatatccacctacacgttgtcataatctcctcattcacgtgattcatttcgtgacactagtttctcactttcccccccgcacctatagtcaacttggcggacacgctacttgtagctgacgttgatttatagacccaatcaaagcgggttatcggtcaggtagcacttatcattcatcgttcatactacgatgagcaatctcgggcatgtccggaaaagtgtcgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccgacagcagcgactgggcaccatgatcaagcgaaacaccttcccccagctgccctggcaaaccatcaagaaccctactttcatcaagtgcaagaacggttctactcttctcacctccggtgtctacggctggtgccgaaagcctaactacaccgctgatttcatcatgtgcctcacctgggctctcatgtgcggtgttgcttctcccctgccttacttctacccggtcttcttcttcctggtgctcatccaccgagcttaccgagactttgagcgactggagcgaaagtacggtgaggactaccaggagttcaagcgacaggtcccttggatcttcatcccttatgttttctaaacgataagcttagtgagcgaatggtgaggttacttaattgagtggccagcctatgggattgtataacagacagtcaatatattactgaaaagactgaacagccagacggagtgaggttgtgagtgaatcgtagagggcggctattacagcaagtctactctacagtgtactaacacagcagagaacaaatacaggtgtgcattcggctatctgagaattagttggagagctcgagaccctcggcgataaactgctcctcggttttgtgtccatacttgtacggaccattgtaatggggcaagtcgttgagttctcgtcgtccgacgttcagagcacagaaaccaatgtaatcaatgtagcagagatggttctgcaaaagattgatttgtgcgagcaggttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaaccatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacaccatg

SEQ ID NO: 111 - DNA, 47 bp, Artificial Sequence
  Primer SNF1RD-F
gatcaaacatgtcggacccctggtttaaacagggcattgccgagtac

SEQ ID NO: 112 - DNA, 9405 bp, Artificial Sequence
  Plasmid pYRH40
catgtcgaccgaacacgtggaacacgccgaaaacgccaagcagtcgccccaaccgtccttctcgggctccgagagcggccgaattggccggtaccaaatcatcaagactctgggagagggctcctttggcaaggtcaagctcgcctaccatctggccacccacgaaaaagtagcgctcaaaatcatcaacagaaagacgctggccaagtcggatatgcagggccgagtcgagcgggaaatctcgtacctgcgactgctcagacacccccacatcatcaagctgtacgacgtgatcaagtccaaggatgaaatcatcatggtgattgaatttgccggcaaggagctctttgactacattgtgcaacgtggaaagatgcccgaagacgaggctaggcgattcttccaacaaatcatctccgcagtcgagtactgccatagacacaagattgtgcacagagacctcaagcccgagaacctgttgctcgacgaaaacctcaacgtcaagattgccgcctttggactctccaacattatgaccgatggtaacttcctcaagaccagttgtggctctcccaactatgctgctcccgaggttatcagtggcaagctgtatgctggccccgaggtcgacgtgtggtcctgtggtgtcattctatacgtcatgctgtgcggccgtctcccctttgacgacgaattcatccccaacctcttcaagaagatctccaatggtgtctacaccattcccccctatctgtctgccggcgcaaaacacctgcttcaacagatgctggtggtcaaccccctgaaccgaatcaccgtccagggcatcatggaagacccctggtttaaacagggcattgccgagtaccttgttccacgtgacctgaagcctgatcaggtggaaatcgacgacaaggttgtgggtgctctttcagacaccatgggctacgaccgagaccaggtctacgaggctctcaaggctcctaaatccgacggaaccgaaatccgagatgcctacgacctcatgaaggagaacagacagcagttggagaaggactcgaccgtgttcgacaaggtggacgaatccggcaagcctaagcaccagttctcgcgaaagaacccgccggctctgacgtttgactcacatcacatgcccaccattgtcgaccattctgatcttcgaacccctaacacaaccattgctgttcttccctcctcgctgccagcataccatcgggccaacatgatggcccatggtcccgctaccctgcgtaagctgaatcccatctcatcgcgaaaatcaaagacccgatggcatttcggcattcggtccaagtcgtaccctctcgacgtgatgggtgagctctaccgagctctcaagaacctgggagccgagtgggcaaagccatcagagaacgacctgtggaccatcagggtgcgatggagatacacccctgaaaaggatgagtcggacagcacaactaagccagacagcggactgcttaagatgcagattcaactgtatctgctggagcagaactcgtacttggtggacttcaagtttgacggctgggagtgcgagacggagagcggtgagattaagacccgcgatgtcgcccaggtgtcgaattcaaagtccgccaacgagaccttcacgttttccgcataccccttcttgcatctggccacccggctcattatggagctggccgtgagttctcagaaggagagtgagaagtaagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgttgattgaggtggagccagatgggctattgtttcatatatagactggcagccacctctttggcccagcatgtttgtatacctggaagggaaaactaaagaagctggctagtttagtttgattattatagtagatgtcctaatcactagagattagaatgtcttggcgatgattagtcgtcgtcccctgtatcatgtctagaccaactgtgtcatgaagttggtgctggtgttttacctgtgtactacaagtaggtgtcctagatctagtgtacagagccgtttagacccatgtggacttcaccattaacgatggaaaatgttcattatatgacagtatattacaatggacttgctccatttcttccttgcatcacatgttctccacctccatagttgatcaacacatcatagtagctaaggctgctgctctcccactacagtccaccacaagttaagtagcaccgtcagtacagctaaaagtacacgtctagtacgtttcataactagtcaagtagcccctattacagatatcagcactatcacgcacgagtttttctctgtgctatctaatcaacttgccaagtattcggagaagatacactttcttggcatcaggtatacgagggagcctatcagatgaaaaagggtatattggatccattcatatccacctacacgttgtcataatctcctcattcacgtgattcatttcgtgacactagtttctcactttcccccccgcacctatagtcaacttggcggacacgctacttgtagctgacgttgatttatagacccaatcaaagcgggttatcggtcaggtagcacttatcattcatcgttcatactacgatgagcaatctcgggcatgtccggaaaagtgtcgggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcattccgacagcagcgactgggcaccatgatcaagcgaaacaccttcccccagctgccctggcaaaccatcaagaaccctactttcatcaagtgcaagaacggttctactcttctcacctccggtgtctacggctggtgccgaaagcctaactacaccgctgatttcatcatgtgcctcacctgggctctcatgtgcggtgttgcttctcccctgccttacttctacccggtcttcttcttcctggtgctcatccaccgagcttaccgagactttgagcgactggagcgaaagtacggtgaggactaccaggagttcaagcgacaggtcccttggatcttcatcccttatgttttctaaacgataagcttagtgagcgaatggtgaggttacttaattgagtggccagcctatgggattgtataacagacagtcaatatattactgaaaagactgaacagccagacggagtgaggttgtgagtgaatcgtagagggcggctattacagcaagtctactctacagtgtactaacacagcagagaacaaatacaggtgtgcattcggctatctgagaattagttggagagctcgagaccctcggcgataaactgctcctcggttttgtgtccatacttgtacggaccattgtaatggggcaagtcgttgagttctcgtcgtccgacgttcagagcacagaaaccaatgtaatcaatgtagcagagatggttctgcaaaagattgatttgtgcgagcaggttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgtttaaaccatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacac

SEQ ID NO: 113 - DNA, 34 bp, Artificial Sequence
  Primer YlSnf1D171A-F
caacgtcaagattgccgcctttggactctccaac

SEQ ID NO: 114 - DNA, 34 bp, Artificial Sequence
  Primer YlSnf1D171A-R
gttggagagtccaaaggcggcaatcttgacgttg

SEQ ID NO: 115 - DNA, 1209 bp, Yarrowia lipolytica
  CDS (1)..(1209): Locus YALI0E19965g within public Y. lipolytica protein database of the "Yeast project Genolevures" (Center for Bioinformatics, LaBRI, Talence Cedex, France); Rme1p
atgtcttcctatccgcaaagttcaacgtttctcttccccaacactcaacagacattgtcctacagacacgagaggtactacacctcaccaccgccaccaccgtgcattgagggcaactactactcttcggtaccgctggatattccctgtaccagagacagaaatttgctcaccgatgactacctccttacaacccctctggcgtctcctccagatctccatctgggcagccaacatgaagcctcttggggctcccaccaacaagatattgctgcggtattgtttggtgcgaccaacgacaatgtggcctcgtctaggtacagtgtcgctcatggcctggaacctgctcatgtgctatctagttcgtggcctggtcacacaggtgctgcagatggaggatatctttccctcgatactacgcccggatctctgtccaccagccaatctgatctctctggtggtctacctgttgagactcccccgagcgacctagacggtgccacggccgaagagacagacgtcttttccctgcacatgatgtcgccgttcctgtcgccctatcttcagccccgactgccctccgctgagaccacctcacacaatccatcacccaccgcgctgttcgatccgctgccgtccacaccgccagacacagaagctgcccacgtgcctcgaagcgagggcccacaaaaatgcggcattctggccctgctcatggccaacccagccatgtggcgccaggcaaccctctccaagaaaggcacctacgtgtgcagccactgcacgtccctgggcaaccccagaaagttcagcaacctggctgcgctggccgcccactttgaccaccacgaggtgatgcgtctgtgcaagtgtgactacaccagctgcgtgtggtccctgatcggcttttcgtccatgcccgagaagatgcgacacctgagatcccaacacagtaacaagcactacaagtgcggggcgtgtcaacgggcgtttctcaggggcgactctctcaaacgacatctgcgattagttcatggccaagaacacacaaccgctgccgaaatcaacgaaatgaccgtcatggggccgtttgagcctacggtgagaaggactagtactgcgaccagcagttcgaaccgctccagcaccaaatccccaccgccctccacctacgagccggtgtttgattttctctgtttgactccttaa

SEQ ID NO: 116 - protein, 402 aa, Yarrowia lipolytica
MSSYPQSSTFLFPNTQQTLSYRHERYYTSPPPPPCIEGNYYSSVPLDIPCTRDRNLLTDDYLLTTPLASPPDLHLGSQHEASWGSHQQDIAAVLFGATNDNVASSRYSVAHGLEPAHVLSSSWPGHTGAADGGYLSLDTTPGSLSTSQSDLSGGLPVETPPSDLDGATAEETDVFSLHMMSPFLSPYLQPRLPSAETTSHNPSPTALFDPLPSTPPDTEAAHVPRSEGPQKCGILALLMANPAMWRQATLSKKGTYVCSHCTSLGNPRKFSNLAALAAHFDHHEVMRLCKCDYTSCVWSLIGFSSMPEKMRHLRSQHSNKHYKCGACQRAFLRGDSLKRHLRLVHGQEHTTAAEINEMTVMGPFEPTVRRTSTATSSSNRSSTKSPPPSTYEPVFDFLCLTP

SEQ ID NO: 117 - DNA, 8201 bp, Artificial Sequence
  Plasmid pYRH49
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcttcctatccgcaaagttcaacgtttctcttccccaacactcaacagacattgtcctacagacacgagaggtactacacctcaccaccgccaccaccgtgcattgagggcaactactactcttcggtaccgctggatattccctgtaccagagacagaaatttgctcaccgatgactacctccttacaacccctctggcgtctcctccagatctccatctgggcagccaacatgaagcctcttggggctcccaccaacaagatattgctgcggtattgtttggtgcgaccaacgacaatgtggcctcgtctaggtacagtgtcgctcatggcctggaacctgctcatgtgctatctagttcgtggcctggtcacacaggtgctgcagatggaggatatctttccctcgatactacgcccggatctctgtccaccagccaatctgatctctctggtggtctacctgttgagactcccccgagcgacctagacggtgccacggccgaagagacagacgtcttttccctgcacatgatgtcgccgttcctgtcgccctatcttcagccccgactgccctccgctgagaccacctcacacaatccatcacccaccgcgctgttcgatccgctgccgtccacaccgccagacacagaagctgcccacgtgcctcgaagcgagggcccacaaaaatgcggcattctggccctgctcatggccaacccagccatgtggcgccaggcaaccctctccaagaaaggcacctacgtgtgcagccactgcacgtccctgggcaaccccagaaagttcagcaacctggctgcgctggccgcccactttgaccaccacgaggtgatgcgtctgtgcaagtgtgactacaccagctgcgtgtggtccctgatcggcttttcgtccatgcccgagaagatgcgacacctgagatcccaacacagtaacaagcactacaagtgcggggcgtgtcaacgggcgtttctcaggggcgactctctcaaacgacatctgcgattagttcatggccaagaacacacaaccgctgccgaaatcaacgaaatgaccgtcatggggccgtttgagcctacggtgagaaggactagtactgcgaccagcagttcgaaccgctccagcaccaaatccccaccgccctccacctacgagccggtgtttgattttctctgtttgactccttaagc

SEQ ID NO: 118 - DNA, 45 bp, Artificial Sequence
  Primer RME1-F
gatcaaccatggcttcctatccgcaaagttcaacgtttctcttcc

SEQ ID NO: 119 - DNA, 45 bp, Artificial Sequence
  Primer RME1-R
gatcaagcggccgcttaaggagtcaaacagagaaaatcaaacacc

SEQ ID NO: 120 - DNA, 858 bp, Yarrowia lipolytica
  CDS (1)..(858): Locus YALI0B21582 within public Y. lipolytica protein database of the "Yeast project Genolevures" (Center for Bioinformatics, LaBRI, Talence Cedex, France); Mhy1p
atggacctcgaattggaaattcccgtcttgcattccatggactcgcaccaccaggtggtggactcccacagactggcacagcaacagttccagtaccagcagatccacatgctgcagcagacgctgtcacagcagtacccccacaccccatccaccacaccccccatttacatgctgtcgcctgcggactacgagaaggacgccgtttccatctcaccggtaatgctgtggcccccctcggcccactcccaggcctcttaccattacgagatgccctccgttatctcgccatctccttctcccactagatccttctgtaatccgagagagctggaggttcaggacgagctcgagcagcttgaacagcagcccgccgctctctccgtcgaacatctgtttgacattgagaactcatcgatcgagtatgcacacgacgagctgcatgacacctcttcgtgctccgactcgcagtcgagcttttcccctcagcagtcccctgcctccccggcctccacttactcgcctctcgaggacgagtttctcaacttggctggatccgagttgaagagcgagcccagcgcggacgacgagaaggatgatgtggacacggagcttccccagcagcccgagatcatcatccctgtgtcgtgccgaggccgaaagccgtccatcgacgactccaaaaagacttttgtctgcacccactgccagcgtcggttccggcgccaggagcatctcaagcgacatttccgatccctacacactcgagagaagcctttcaactgcgacacgtgcggcaagaagttttctcggtcggacaatctcgcccagcatatgcgtacgcatcctcgggactag

SEQ ID NO: 121 - protein, 285 aa, Yarrowia lipolytica
MDLELEIPVLHSMDSHHQVVDSHRLAQQQFQYQQIHMLQQTLSQQYPHTPSTTPPIYMLSPADYEKDAVSISPVMLWPPSAHSQASYHYEMPSVISPSPSPTRSFCNPRELEVQDELEQLEQQPAALSVEHLFDIENSSIEYAHDELHDTSSCSDSQSSFSPQQSPASPASTYSPLEDEFLNLAGSELKSEPSADDEKDDVDTELPQQPEIIIPVSCRGRKPSIDDSKKTFVCTHCQRRFRRQEHLKRHFRSLHTREKPFNCDTCGKKFSRSDNLAQHMRTHPRD

SEQ ID NO: 122 - DNA, 8966 bp, Artificial Sequence
  Plasmid pYRH41
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgtctgaagaccacccagccatccacccaccctccgagttcaaggacaaccacccccacttcggaggcccccacctcgactgtctgcaggactaccaccagctgcacaaggagtccattgaggaccccaaggccttctggaagaagatggccaacgagctcatctcctggtcaaccccctttgaaactgtgcgatctggcggcttcgagcacggcgacgtggcctggttccccgagggccagctcaacgcctcctacaactgtgtggatcgacacgcctttgccaaccccgacaagcccgccatcatttttgaggccgatgagccgggccagggccgaatcgtcacctacggcgaactgctgcgacaggtgtctcaggtcgcagccaccctgcgatccttcggcgtccagaagggcgatactgtggccgtctacctgcccatgatccccgaggccattgtcactctgctggccatcacccgaattggcgctgtccactcggtcatcttcgccggcttctcctccggttctctgcgagaccgaatcaacgacgccaagtccaaggttgtcgtcaccaccgacgcctccatgcgaggaggcaagaccatcgacaccaagaagattgtcgatgaagccttgcgagactgcccctctgttacccacaccctggtcttccgacgagcaggtgtcgagaacctggcctggactgagggccgggacttctggtggcacgaggaggtcgtcaagcaccgaccctaccttgcccccgtccccgttgcctccgaggaccccatcttcctgctttacacctctggatccaccggcacccccaagggtctggcccacgctaccggtggctacctgcttggtgctgccctgaccgccaagtacgtgtttgacatccacggagacgacaagctgttcaccgctggagacgttggctggatcaccggccacacctacgtgctctacggtcctctgatgctcggagccaccactgttgtgttcgagggaacccctgcctacccctccttctcgcgatactgggacattgtcgacgaccacaagatcacccacttctacgtggctcccaccgccctgcgtctcctgaagcgggccggcacccatcacattaagcacgacctgtcgtctctgcgaaccctcggctctgtgggtgagcccattgcccccgacgtgtggcagtggtacaacgacaacattggccgaggcaaggcccacatctgtgacacctactggcagaccgagactggctcgcatatcattgcccccatggccggcgtgacccccaccaagcccggttctgcttccctgcctgtctttggaattgatcccgttatcattgatcccgtgtctggcgaggagctcaagggtaacaacgttgagggtgttcttgccctgcgatctccctggccctccatggcccgaaccgtgtggaacacccacgagcgatacatggagacctacctgcggccctaccccggctactacttcaccggtgatggtgctgcccgagacaatgacggcttttactggatccgaggccgagtcgacgacgttgtcaacgtttctggccaccgtctttccaccgccgagattgaggctgctctcattgagcacgctcaggtgtctgagtctgccgttgttggtgtccatgacgatctgactggccaggccgtcaacgcctttgtggctctcaagaaccccgtcgaggatgtggacgctctgcgaaaggagcttgttgtgcaggtgcgaaagaccattggaccctttgctgctcccaagaatgtcatcatcgtggacgatctgcccaagactcggtctggcaagatcatgcgacgaattctgcgaaaggtgcttgctggcgaggaggaccagctcggagacatttccactcttgctaaccccgacgttgtccagaccatcattgaggttgttcactcgttgaaaaagtaagc

SEQ ID NO: 123 - DNA, 8713 bp, Artificial Sequence
  Plasmid pYRH42
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaaatcaccccggaaaagctggagtttcacggtgagtatgagcgcaacaaggatggcagaaacggacgaccgcccggtcttatataccccctgcaacacacaatgccgccatagtggcccctcccagtcacatgcgccaggaaacgtcacatctgcgctttttgtagacaagacacaaacagcagctcgacgacaagcccggagagtgtgcgggaatggaccgcgggctcagggtcggcgtcgggtgctcagctgccctgggtctgctcggccgtgcctgttgctctgttgcgtctttttcgcaaccgacgagtgacacagacgcaatctagacccacagacacagacggcgcaaacagcgcatcgtcagagacatggtatttgttcctctgtgcctccgcacgaccaattccgccgacggattgtgtctcggctaattgctcaattgtgggaaaccgggcacgtgagcactcaatctggcaatatggcgaggcggcgcacgcagacgacattgctcgctaagtggtggtcgtacgagcatccagatacgctcaatgggtcggtagtgtctgtgaatgatcgcttcttgctctttagcaacgtcatctgcagcaagcccggcaaacatcagtgaaatggcgaggacaacagagcagcaagccagactacgctgaacattgaaggaacagggtaccggcatccttgtgtgagctgctcgctatggttgctattcgtgtctaagacgccgacccacacgtctgctctgtatctccggcatctccacggaatctccgcatccgtttactaacccagctcccttcactaagcacacatccaacaatctggagctgcgaaaccctactaacgagtactttgccttcaaggtcaagaccacagcccccaagttgttctgcgtccgaccaaacgcctccattgtcgcccccaatgagagcctgaccgtgtccattacccaccaggccctcccccaggagcccggtcccgactacacctccaaggacaagttcctgattctgtcggcacctctcaacgaggctgccgtccaggccggtgagaacctcgccaactttgttgagaagactaaggagaacattgccgagttctggacccaggccgaacacaccaagtccgtgcccatcaccagcaaaaagatgaaggtgcaggtgcgaccctttgacgccaacggtcagcactctcacgagctcggagccggaggcgccgcccttggagctggggccgtggctggaggtgcccttggccacagcgcctctcgaggcgaccagactctcggcgacgagtcctttgccaactacgaggctgccgcccagtctcctgctccccactcccctgccaaccagcagtttaacaacttccagcagcagcagcagcaacactaccagcagcaggttccctcctctgcctccggtattgcttctcatccgaccgaggccgtcaaccgaggcgctgaggccgttggtgctccctctgcctcctctcaggtccactcccaggactctgctgcccttggacaggcacaggacaacatttcttctctcaagaaggacatcggaagcacctctgagaagcatactgttccctctacccaaacctctcaggctgtcggctcccagggtgtgcctgttggagttgttgctattgttgctctcctggctcttcttgttggatggttcttcttataggc

SEQ ID NO: 124 - DNA, 7865 bp, Artificial Sequence
  Plasmid pYRH48
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgggctcctcttcttcacgacaacctcaaatgcagtcctattacgccatcgccaccgtgtgggcgctcatcattggcgccgccacctactacttcttctccaactccaagcccaaggctgtcttgcagcgaggagatacggccttcaaggagttccctctcatccagaagacggtgctctctcacaattcggccatctatcgatttggcctgccccgaccctcccacgtgctgggtctgcccatcggacagcacgtgtcgctttctgccaacattggaggcaaggaggtgctgcgttcctacacccccacctcgtccgacctgtacgacaagggctacttcgacattctcatcaagacctacccccagggaaacatctccaagtacgtgtctgagctggccattggtgacactatgaaggtgcggggccccaagggcaactttgtctacaaccacggcctggtcgagtccttcggcatggtttgtggaggaaccggcatcacccccatgtaccagattctgcgacacattgccgccgatcccgccgacaacaccaaggttaacctcgtctacgccaacgtgaaccacgacgacattctgctcaagaaggagctggacgccattgccgccgagaacgacaacatcaagatccactacgtgctcaacaacgctcccgaggactggaccggttccgtgggctttgtcaccaaggagattctcgagaagcactgcccccctcctggccccaacaccaagctgcttctgtgtggcccccctcccatgatctctgctctcaagaaggcttccgtcgagctcggatacgagaaggcccgacctgtcagcaaacttgaggatcaggtctttgccttttaagc

SEQ ID NO: 125 - DNA, 8243 bp, Artificial Sequence
  Plasmid pYRH51
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggacaaactcaacgcccgactcggaaacctccggctggaagaggtgatcggaactggagcctatggcaccgtctacagagccactgacatttactcgagcaaacgatacgcagtcaaggtggttggcaagcgctcgcaactgaacgactgccgcggccaggtcatcaacgcccacaagctgtctctccaacaggtttctctggcggccctcaaccacaacgcatcccacatctaccgagaaatcgccctccataaccatgtccaggtccacccctacattctgtcgctgtacgccgtctacgaggccagcgactgtctctacattgttctggagcactgcgaggacgacctcttcaccgctattgtcgaccggggcatgttccagacctacgcccccagtgccaagatcatcctgctccaactgctcgaggccgtcctctacacccacaacaagggcgtcttccactgcgatcttaagccagaaaatattctcgtggccgagggaggcacttgcattcggctggcagactttggcctggcctcacgatccggacaacaggtgtcccagtgcggttcgtccttctacatgtctcccgagcgacagaccaagcgccacagctccttgtccgtgcagcagatcaatgccggaaacgctgccgccgatatctggagcctgggagttattgccatcaatctcttttgtggcagaaacccctggaaacgggcccacgtctcggacgaggcctaccgccagtacctcaaggacccgtcgttcctgcagcagatcctgcctgttagcgatgagtttgccggcattctcaaccgcatcttcaccgccgatgtcaagtcgagaatcagcctcacccagctccgagaacagatcaagaactgcgacatgtttgtacttggacaggacactgaggagaggcctgcaacctctgccattcctacatacaccaaggcgcctattcctcccacgtctcccgtgtctctgctccctgctccttctctcaaatcaaacctgtcacctctcagtcacacctccagtgtatcgcctctcagccacacgtcgtccatcttctcgacgccctacactcccgacgtatccccaacggccgtgtcggatcgaggcgtcaagcgtcgacgcagcgaggagaacgagccgttccacttttcgctcaaccataccagcgacgtggaccggttcgactttggcatgagcgacccccgagcccgactgttcgcctaagc

SEQ ID NO: 126 - DNA, 1974 bp, Yarrowia lipolytica
  CDS (1)..(1974): Locus YALI0F05962g within public Y. lipolytica protein database of the "Yeast project Genolevures" (Center for Bioinformatics, LaBRI, Talence Cedex, France); Asc2p
atgtctgaagaccacccagccatccacccaccctccgagttcaaggacaaccacccccacttcggaggcccccacctcgactgtctgcaggactaccaccagctgcacaaggagtccattgaggaccccaaggccttctggaagaagatggccaacgagctcatctcctggtcaaccccctttgaaactgtgcgatctggcggcttcgagcacggcgacgtggcctggttccccgagggccagctcaacgcctcctacaactgtgtggatcgacacgcctttgccaaccccgacaagcccgccatcatttttgaggccgatgagccgggccagggccgaatcgtcacctacggcgaactgctgcgacaggtgtctcaggtcgcagccaccctgcgatccttcggcgtccagaagggcgatactgtggccgtctacctgcccatgatccccgaggccattgtcactctgctggccatcacccgaattggcgctgtccactcggtcatcttcgccggcttctcctccggttctctgcgagaccgaatcaacgacgccaagtccaaggttgtcgtcaccaccgacgcctccatgcgaggaggcaagaccatcgacaccaagaagattgtcgatgaagccttgcgagactgcccctctgttacccacaccctggtcttccgacgagcaggtgtcgagaacctggcctggactgagggccgggacttctggtggcacgaggaggtcgtcaagcaccgaccctaccttgcccccgtccccgttgcctccgaggaccccatcttcctgctttacacctctggatccaccggcacccccaagggtctggcccacgctaccggtggctacctgcttggtgctgccctgaccgccaagtacgtgtttgacatccacggagacgacaagctgttcaccgctggagacgttggctggatcaccggccacacctacgtgctctacggtcctctgatgctcggagccaccactgttgtgttcgagggaacccctgcctacccctccttctcgcgatactgggacattgtcgacgaccacaagatcacccacttctacgtggctcccaccgccctgcgtctcctgaagcgggccggcacccatcacattaagcacgacctgtcgtctctgcgaaccctcggctctgtgggtgagcccattgcccccgacgtgtggcagtggtacaacgacaacattggccgaggcaaggcccacatctgtgacacctactggcagaccgagactggctcgcatatcattgcccccatggccggcgtgacccccaccaagcccggttctgcttccctgcctgtctttggaattgatcccgttatcattgatcccgtgtctggcgaggagctcaagggtaacaacgttgagggtgttcttgccctgcgatctccctggccctccatggcccgaaccgtgtggaacacccacgagcgatacatggagacctacctgcggccctaccccggctactacttcaccggtgatggtgctgcccgagacaatgacggcttttactggatccgaggccgagtcgacgacgttgtcaacgtttctggccaccgtctttccaccgccgagattgaggctgctctcattgagcacgctcaggtgtctgagtctgccgttgttggtgtccatgacgatctgactggccaggccgtcaacgcctttgtggctctcaagaaccccgtcgaggatgtggacgctctgcgaaaggagcttgttgtgcaggtgcgaaagaccattggaccctttgctgctcccaagaatgtcatcatcgtggacgatctgcccaagactcggtctggcaagatcatgcgacgaattctgcgaaaggtgcttgctggcgaggaggaccagctcggagacatttccactcttgctaaccccgacgttgtccagaccatcattgaggttgttcactcgttgaaaaagtaa

SEQ ID NO: 127 - protein, 657 aa, Yarrowia lipolytica
MSEDHPAIHPPSEFKDNHPHFGGPHLDCLQDYHQLHKESIEDPKAFWKKMANELISWSTPFETVRSGGFEHGDVAWFPEGQLNASYNCVDRHAFANPDKPAIIFEADEPGQGRIVTYGELLRQVSQVAATLRSFGVQKGDTVAVYLPMIPEAIVTLLAITRIGAVHSVIFAGFSSGSLRDRINDAKSKVVVTTDASMRGGKTIDTKKIVDEALRDCPSVTHTLVFRRAGVENLAWTEGRDFWWHEEVVKHRPYLAPVPVASEDPIFLLYTSGSTGTPKGLAHATGGYLLGAALTAKYVFDIHGDDKLFTAGDVGWITGHTYVLYGPLMLGATTVVFEGTPAYPSFSRYWDIVDDHKITHFYVAPTALRLLKRAGTHHIKHDLSSLRTLGSVGEPIAPDVWQWYNDNIGRGKAHICDTYWQTETGSHIIAPMAGVTPTKPGSASLPVFGIDPVIIDPVSGEELKGNNVEGVLALRSPWPSMARTVWNTHERYMETYLRPYPGYYFTGDGAARDNDGFYWIRGRVDDVVNVSGHRLSTAEIEAALIEHAQVSESAVVGVHDDLTGQAVNAFVALKNPVEDVDALRKELVVQVRKTIGPFAAPKNVIIVDDLPKTRSGKIMRRILRKVLAGEEDQLGDISTLANPDVVQTIIEVVHSLKK

SEQ ID NO: 128 - DNA, 1251 bp, Yarrowia lipolytica
  CDS (1)..(1251): Locus YALI0B08558 within public Y. lipolytica protein database of the "Yeast project Genolevures" (Center for Bioinformatics, LaBRI, Talence Cedex, France); Sks1p
atgcacaaactcaacgcccgactcggaaacctccggctggaagaggtgatcggaactggagcctatggcaccgtctacagagccactgacatttactcgagcaaacgatacgcagtcaaggtggttggcaagcgctcgcaactgaacgactgccgcggccaggtcatcaacgcccacaagctgtctctccaacaggtttctctggcggccctcaaccacaacgcatcccacatctaccgagaaatcgccctccataaccatgtccaggtccacccctacattctgtcgctgtacgccgtctacgaggccagcgactgtctctacattgttctggagcactgcgaggacgacctcttcaccgctattgtcgaccggggcatgttccagacctacgcccccagtgccaagatcatcctgctccaactgctcgaggccgtcctctacacccacaacaagggcgtcttccactgcgatcttaagccagaaaatattctcgtggccgagggaggcacttgcattcggctggcagactttggcctggcctcacgatccggacaacaggtgtcccagtgcggttcgtccttctacatgtctcccgagcgacagaccaagcgccacagctccttgtccgtgcagcagatcaatgccggaaacgctgccgccgatatctggagcctgggagttattgccatcaatctcttttgtggcagaaacccctggaaacgggcccacgtctcggacgaggcctaccgccagtacctcaaggacccgtcgttcctgcagcagatcctgcctgttagcgatgagtttgccggcattctcaaccgcatcttcaccgccgatgtcaagtcgagaatcagcctcacccagctccgagaacagatcaagaactgcgacatgtttgtacttggacaggacactgaggagaggcctgcaacctctgccattcctacatacaccaaggcgcctattcctcccacgtctcccgtgtctctgctccctgctccttctctcaaatcaaacctgtcacctctcagtcacacctccagtgtatcgcctctcagccacacgtcgtccatcttctcgacgccctacactcccgacgtatccccaacggccgtgtcggatcgaggcgtcaagcgtcgacgcagcgaggagaacgagccgttccacttttcgctcaaccataccagcgacgtggaccggttcgactttggcatgagcgacccccgagcccgactgttcgcctaa

SEQ ID NO: 129 - protein, 416 aa, Yarrowia lipolytica
MHKLNARLGNLRLEEVIGTGAYGTVYRATDIYSSKRYAVKVVGKRSQLNDCRGQVINAHKLSLQQVSLAALNHNASHIYREIALHNHVQVHPYILSLYAVYEASDCLYIVLEHCEDDLFTAIVDRGMFQTYAPSAKIILLQLLEAVLYTHNKGVFHCDLKPENILVAEGGTCIRLADFGLASRSGQQVSQCGSSFYMSPERQTKRHSSLSVQQINAGNAAADIWSLGVIAINLFCGRNPWKRAHVSDEAYRQYLKDPSFLQQILPVSDEFAGILNRIFTADVKSRISLTQLREQIKNCDMFVLGQDTEERPATSAIPTYTKAPIPPTSPVSLLPAPSLKSNLSPLSHTSSVSPLSHTSSIFSTPYTPDVSPTAVSDRGVKRRRSEENEPFHFSLNHTSDVDRFDFGMSDPRARLFA

SEQ ID NO: 130 - DNA, 873 bp, Yarrowia lipolytica
  CDS (1)..(873): Locus YALI0D04983g within public Y. lipolytica protein database of the "Yeast project Genolevures" (Center for Bioinformatics, LaBRI, Talence Cedex, France); Cbr1p
atgcgctcctcttcttcacgacaacctcaaatgcagtcctattacgccatcgccaccgtgtgggcgctcatcattggcgccgccacctactacttcttctccaactccaagcccaaggctgtcttgcagcgaggagatacggccttcaaggagttccctctcatccagaagacggtgctctctcacaattcggccatctatcgatttggcctgccccgaccctcccacgtgctgggtctgcccatcggacagcacgtgtcgctttctgccaacattggaggcaaggaggtgctgcgttcctacacccccacctcgtccgacctgtacgacaagggctacttcgacattctcatcaagacctacccccagggaaacatctccaagtacgtgtctgagctggccattggtgacactatgaaggtgcggggccccaagggcaactttgtctacaaccacggcctggtcgagtccttcggcatggtttgtggaggaaccggcatcacccccatgtaccagattctgcgacacattgccgccgatcccgccgacaacaccaaggttaacctcgtctacgccaacgtgaaccacgacgacattctgctcaagaaggagctggacgccattgccgccgagaacgacaacatcaagatccactacgtgctcaacaacgctcccgaggactggaccggttccgtgggctttgtcaccaaggagattctcgagaagcactgcccccctcctggccccaacaccaagctgcttctgtgtggcccccctcccatgatctctgctctcaagaaggcttccgtcgagctcggatacgagaaggcccgacctgtcagcaaacttgaggatcaggtctttgccttttaa

SEQ ID NO: 131 - protein, 290 aa, Yarrowia lipolytica
MRSSSSRQPQMQSYYAIATVWALIIGAATYYFFSNSKPKAVLQRGDTAFKEFPLIQKTVLSHNSAIYRFGLPRPSHVLGLPIGQHVSLSANIGGKEVLRSYTPTSSDLYDKGYFDILIKTYPQGNISKYVSELAIGDTMKVRGPKGNFVYNHGLVESFGMVCGGTGITPMYQILRHIAADPADNTKVNLVYANVNHDDILLKKELDAIAAENDNIKIHYVLNNAPEDWTGSVGFVTKEILEKHCPPPGPNTKLLLCGPPPMISALKKASVELGYEKARPVSKLEDQVFAF

SEQ ID NO: 132 - DNA, 1721 bp, Yarrowia lipolytica
  misc_feature (1)..(1721): Locus YALI0D05291g within public Y. lipolytica protein database of the "Yeast project Genolevures" (Center for Bioinformatics, LaBRI, Talence Cedex, France); Scs2p
  CDS (1)..(34)
  Intron (35)..(816)
  CDS (817)..(1718)
atggaaatcaccccggaaaagctggagtttcacggtgagtatgagcgcaacaaggatggcagaaacggacgaccgcccggtcttatataccccctgcaacacacaatgccgccatagtggcccctcccagtcacatgcgccaggaaacgtcacatctgcgctttttgtagacaagacacaaacagcagctcgacgacaagcccggagagtgtgcgggaatggaccgcgggctcagggtcggcgtcgggtgctcagctgccctgggtctgctcggccgtgcctgttgctctgttgcgtctttttcgcaaccgacgagtgacacagacgcaatctagacccacagacacagacggcgcaaacagcgcatcgtcagagacatggtatttgttcctctgtgcctccgcacgaccaattccgccgacggattgtgtctcggctaattgctcaattgtgggaaaccgggcacgtgagcactcaatctggcaatatggcgaggcggcgcacgcagacgacattgctcgctaagtggtggtcgtacgagcatccagatacgctcaatgggtcggtagtgtctgtgaatgatcgcttcttgctctttagcaacgtcatctgcagcaagcccggcaaacatcagtgaaatggcgaggacaacagagcagcaagccagactacgctgaacattgaaggaacagggtaccggcatccttgtgtgagctgctcgctatggttgctattcgtgtctaagacgccgacccacacgtctgctctgtatctccggcatctccacggaatctccgcatccgtttactaacccagctcccttcactaagcacacatccaacaatctggagctgcgaaaccctactaacgagtactttgccttcaaggtcaagaccacagcccccaagttgttctgcgtccgaccaaacgcctccattgtcgcccccaatgagagcctgaccgtgtccattacccaccaggccctcccccaggagcccggtcccgactacacctccaaggacaagttcctgattctgtcggcacctctcaacgaggctgccgtccaggccggtgagaacctcgccaactttgttgagaagactaaggagaacattgccgagttctggacccaggccgaacacaccaagtccgtgcccatcaccagcaaaaagatgaaggtgcaggtgcgaccctttgacgccaacggtcagcactctcacgagctcggagccggaggcgccgcccttggagctggggccgtggctggaggtgcccttggccacagcgcctctcgaggcgaccagactctcggcgacgagtcctttgccaactacgaggctgccgcccagtctcctgctccccactcccctgccaaccagcagtttaacaacttccagcagcagcagcagcaacactaccagcagcaggttccctcctctgcctccggtattgcttctcatccgaccgaggccgtcaaccgaggcgctgaggccgttggtgctccctctgcctcctctcaggtccactcccaggactctgctgcccttggacaggcacaggacaacatttcttctctcaagaaggacatcggaagcacctctgagaagcatactgttccctctacccaaacctctcaggctgtcggctcccagggtgtgcctgttggagttgttgctattgttgctctcctggctcttcttgttggatggttcttcttatag

SEQ ID NO: 133 - protein, 312 aa, Yarrowia lipolytica
MEITPEKLEFHAPFTKHTSNNLELRNPTNEYFAFKVKTTAPKLFCVRPNASIVAPNESLTVSITHQALPQEPGPDYTSKDKFLILSAPLNEAAVQAGENLANFVEKTKENIAEFWTQAEHTKSVPITSKKMKVQVRPFDANGQHSHELGAGGAALGAGAVAGGALGHSASRGDQTLGDESFANYEAAAQSPAPHSPANQQFNNFQQQQQQHYQQQVPSSASGIASHPTEAVNRGAEAVGAPSASSQVHSQDSAALGQAQDNISSLKKDIGSTSEKHTVPSTQTSQAVGSQGVPVGVVAIVALLALLVGWFFL

SEQ ID NO: 134 - DNA, 39 bp, Artificial Sequence
  Primer ACS2-F
gatcaaacatgtctgaagaccacccagccatccacccac

SEQ ID NO: 135 - DNA, 48 bp, Artificial Sequence
  Primer ACS2-R
gatcaagcggccgcttactttttcaacgagtgaacaacctcaatgatg

SEQ ID NO: 136 - DNA, 41 bp, Artificial Sequence
  Primer SCS2-F
gatcaaccatggaaatcaccccggaaaagctggagtttcac

SEQ ID NO: 137 - DNA, 44 bp, Artificial Sequence
  Primer SCS2-R
gatcaagcggccgcctataagaagaaccatccaacaagaagagc

SEQ ID NO: 138 - DNA, 46 bp, Artificial Sequence
  Primer CBR1-F
gatcaaccatgggctcctcttcttcacgacaacctcaaatgcagtc

SEQ ID NO: 139 - DNA, 45 bp, Artificial Sequence
  Primer CBR1-R
gatcaagcggccgcttaaaaggcaaagacctgatcctcaagtttg

SEQ ID NO: 140 - DNA, 42 bp, Artificial Sequence
  Primer SKS1-F
gatcaaccatggacaaactcaacgcccgactcggaaacctcc

SEQ ID NO: 141 - DNA, 49 bp, Artificial Sequence
  Primer SKS1-R
gatcaagcggccgcttaggcgaacagtcgggctcgggggtcgctcatgc

SEQ ID NO: 142 - DNA, 8540 bp, Artificial Sequence
  Plasmid pYRH50
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcgatacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgggactcgctaacatcatcaaccgtggagaaaagcccgagggctcggccttcatggcggcctttgtggccgtgtttgtcgcgtttggaggtattctgtttggatacgacactggaaccatttccggcgtcatggccatgccattcgtcaagaagacctttacagatgacggcctggagttcacttctgagcagacctcgctcatcacttccattctttctgcaggcaccttcactggagccatttctgctccctgggcctctgatactctgggaagacgactgggtctgatcctcttctgtgtcgtcttctctgttggcgctattcttcagactgctgccaccggccgaacgcttttgattgtcggacgagttgttgctggtcttggtgttggtggagtctcttccatcgttcctctttaccagtctgaggttgcccccaagtggatccgaggtgccgttgtctccatctaccagtttgccatcaccattggtcttctgctggctgccattgtcaacaacgcaaccaaaaacaaagacaacagtgcttcctaccgaattcctctcggccttcagcttctgtgggccgtcatcctgagtggaggtctcatcctgctaccggagactcctcgattctggatcaagaagggcgagtacgacaaggccgccgattccctgcgacgactacgacgacttcctgttgagcacgaggctgtacagaaggagctcctggagatccaatcttctcacgaccacgagatgcagatcggtagcgccacctgggccgcctgcttctcccccaaggggtcccagctgaagcgaatgctgaccggtattgccattcaggccctgcagcagctcaccggtatcaacttcatcttctactacggaaccgagttcttcaagaagtccaacatctccaaccccttcctcatccagatgatcaccaacattgtcaacgtggttatgaccatccccggtatcatgtttgttgatcgagtcggacgacgaaagctgctgttgatcggagctatcgtcatgtgctcttccgagtttatcgtggcggctgttggtactgccattgataacgagacctcctcaaaggttctgattgccttcacttgtaccttcattgccggtttcgccgccacctggggtcctattgcctgggttgtcattggagagattttccctctacgaatccgagccaagggtgttgctctatgcgccgcctccaactggcttttcaactttgccattgcctttgcaaccccctacctcgtcgacgaggcccctggatcggccggtctcaagaccaaggtcttcttcatctggggaggctgcaacttcctgtgcatcgccttcacttacttcttcatctacgagaccaagggtcttactctggaggaggtggaccagatgtacgccgagatcaagattgcttctcgatcccaccagtttgtgcctaccactcgagtcgctgcttacgacgagcacgcttctgacgacaagaaggacggacagcacgtctacattgagtctgtctaggc

SEQ ID NO: 143 - DNA, 1548 bp, Yarrowia lipolytica
  CDS (1)..(1548): Locus YALI0C06424g  within public Y. lipolytica protein database of the "Yeast project Genolevures" (Center for Bioinformatics, LaBRI, Talence Cedex, France); Snf3p
atgggactcgctaacatcatcaaccgtggagaaaagcccgagggctcggccttcatggcggcctttgtggccgtgtttgtcgcgtttggaggtattctgtttggatacgacactggaaccatttccggcgtcatggccatgccattcgtcaagaagacctttacagatgacggcctggagttcacttctgagcagacctcgctcatcacttccattctttctgcaggcaccttcactggagccatttctgctccctgggcctctgatactctgggaagacgactgggtctgatcctcttctgtgtcgtcttctctgttggcgctattcttcagactgctgccaccggccgaacgcttttgattgtcggacgagttgttgctggtcttggtgttggtggagtctcttccatcgttcctctttaccagtctgaggttgcccccaagtggatccgaggtgccgttgtctccatctaccagtttgccatcaccattggtcttctgctggctgccattgtcaacaacgcaaccaaaaacaaagacaacagtgcttcctaccgaattcctctcggccttcagcttctgtgggccgtcatcctgagtggaggtctcatcctgctaccggagactcctcgattctggatcaagaagggcgagtacgacaaggccgccgattccctgcgacgactacgacgacttcctgttgagcacgaggctgtacagaaggagctcctggagatccaatcttctcacgaccacgagatgcagatcggtagcgccacctgggccgcctgcttctcccccaaggggtcccagctgaagcgaatgctgaccggtattgccattcaggccctgcagcagctcaccggtatcaacttcatcttctactacggaaccgagttcttcaagaagtccaacatctccaaccccttcctcatccagatgatcaccaacattgtcaacgtggttatgaccatccccggtatcatgtttgttgatcgagtcggacgacgaaagctgctgttgatcggagctatcgtcatgtgctcttccgagtttatcgtggcggctgttggtactgccattgataacgagacctcctcaaaggttctgattgccttcacttgtaccttcattgccggtttcgccgccacctggggtcctattgcctgggttgtcattggagagattttccctctacgaatccgagccaagggtgttgctctatgcgccgcctccaactggcttttcaactttgccattgcctttgcaaccccctacctcgtcgacgaggcccctggatcggccggtctcaagaccaaggtcttcttcatctggggaggctgcaacttcctgtgcatcgccttcacttacttcttcatctacgagaccaagggtcttactctggaggaggtggaccagatgtacgccgagatcaagattgcttctcgatcccaccagtttgtgcctaccactcgagtcgctgcttacgacgagcacgcttctgacgacaagaaggacggacagcacgtctacattgagtctgtctag

SEQ ID NO: 144 - protein, 515 aa, Yarrowia lipolytica
MGLANIINRGEKPEGSAFMAAFVAVFVAFGGILFGYDTGTISGVMAMPFVKKTFTDDGLEFTSEQTSLITSILSAGTFTGAISAPWASDTLGRRLGLILFCVVFSVGAILQTAATGRTLLIVGRVVAGLGVGGVSSIVPLYQSEVAPKWIRGAVVSIYQFAITIGLLLAAIVNNATKNKDNSASYRIPLGLQLLWAVILSGGLILLPETPRFWIKKGEYDKAADSLRRLRRLPVEHEAVQKELLEIQSSHDHEMQIGSATWAACFSPKGSQLKRMLTGIAIQALQQLTGINFIFYYGTEFFKKSNISNPFLIQMITNIVNVVMTIPGIMFVDRVGRRKLLLIGAIVMCSSEFIVAAVGTAIDNETSSKVLIAFTCTFIAGFAATWGPIAWVVIGEIFPLRIRAKGVALCAASNWLFNFAIAFATPYLVDEAPGSAGLKTKVFFIWGGCNFLCIAFTYFFIYETKGLTLEEVDQMYAEIKIASRSHQFVPTTRVAAYDEHASDDKKDGQHVYIESV

SEQ ID NO: 145 - DNA, 44 bp, Artificial Sequence
  Primer SNF3-F
gatcaaccatgggactcgctaacatcatcaaccgtggagaaaag

SEQ ID NO: 146 - DNA, 42 bp, Artificial Sequence
  Primer SNF3-R
gatcaagcggccgcctagacagactcaatgtagacgtgctgt

SEQ ID NO: 147 - protein, 2345 aa, Rattus norvegicus
  MISC_FEATURE (1)..(2345): GenBank Accession No. NP_071529
MDEPSPLAKTLELNQHSRFIIGSVSEDNSEDEISNLVKLDLEEKEGSLSPASVSSDTLSDLGISALQDGLAFHMRSSMSGLHLVKQGRDRKKIDSQRDFTVASPAEFVTRFGGNKVIEKVLIANNGIAAVKCMRSIRRWSYEMFRNERAIRFVVMVTPEDLKANAEYIKMADHYVPVPGGANNNNYANVELILDIAKRIPVQAVWAGWGHASENPKLPELLLKNGIAFMGPPSQAMWALGDKIASSIVAQTAGIPTLPWSGSGLRVDWQENDFSKRILNVPQDLYEKGYVKDVDDGLKAAEEVGYPVMIKASEGGGGKGIRKVNNADDFPNLFRQVQAEVPGSPIFVMRLAKQSRHLEVQILADQYGNAISLFGRDCSVQRRHQKIIEEAPAAIATPAVFEHMEQCAVKLAKMVGYVSAGTVEYLYSQDGSFYFLELNPRLQVEHPCTEMVADVNLPAAQLQIAMGIPLFRIKDIRMMYGVSPWGDAPIDFENSAHVPCPRGHVIAARITSENPDEGFKPSSGTVQELNFRSNKNVWGYFSVAAAGGLHEFADSQFGHCFSWGENREEAISNMVVALKELSIRGDFRTTVEYLIKLLETESFQLNRIDTGWLDRLIAEKVQAERPDTMLGVVCGALHVADVNLRNSISNFLHSLERGQVLPAHTLLNTVDVELIYEGIKYVLKVTRQSPNSYVVIMNGSCVEVDVHRLSDGGLLLSYDGSSYTTYMKEEVDRYRITIGNKTCVFEKENDPSVMRSPSAGKLIQYIVEDGGHVFAGQCYAEIEVMKMVMTLTAVESGCIHYVKRPGAALDPGCVIAKMQLDNPSKVQQAELHTGSLPQIQSTALRGEKLHRVFHYVLDNLVNVMNGYCLPDPFFSSKVKDWVERLMKTLRDPSLPLLELQDIMTSVSGRIPLNVEKSIKKEMAQYASNITSVLCQFPSQQIANILDSHAATLNRKSEREVFFMNTQSIVQLVQRYRSGIRGHMKAVVMDLLRQYLRVETQFQNGHYDKCVFALREENKSDMNTVLNYIFSHAQVTKKNLLVTMLIDQLCGRDPTLTDELLNILTELTQLSKTTNAKVALRARQVLIASHLPSYDVRHNQVESIFLSAIDMYGHQFCIENLQKLILSETSIFDVLPNFFYHSNQVVRMAALEVYVRRAYIAYELNSVQHRQLKDNTCVVEFQFMLPTSHPNRGNIPTLNRMSFASNLNHYGMTHVASVSDVLLDNAFTPPCQRMGGMVSFRTFEDFVRIFDEVMGCFCDSPPQSPTFPESGHTSLYDEDKVPRDEPIHILNVAIKTDGDIEDDRLAAMFREFTQQNKATLVEHGIRRLTFLVAQKDFRKQVNCEVDQRFHREFPKFFTFRARDKFEEDRIYRHLEPALAFQLELNRMRNFDLTAIPCANHKMHLYLGAAKVEVGTEVTDYRFFVRAIIRHSDLVTKEASFEYLQNEGERLLLEAMDELEVAFNNTNVRTDCNHIFLNFVPTVIMDPSKIEESVRSMVMRYGSRLWKLRVLQAELKINIRLTTTGKAIPIRLFLTNESGYYLDISLYKEVTDSRTAQIMFQAYGDKQGPLHGMLINTPYVTKDLLQSKRFQAQSLGTTYIYDIPEMFRQSLIKLWESMSTQAFLPSPPLPSDILTYTELVLDDQGQLVHMNRLPGGNEIGMVAWKMSLKSPEYPDGRDVIVIGNDITYRIGSFGPQEDLLFLRASELARAEGIPRIYVAANSGARIGLAEEIRHMFHVAWVDSEDPYKGYKYLYLTPQDYKRVSALNSVHCEHVEDEGESRYKITDIIGKEEGLGAENLRGSGMIAGESSLAYDEIITISLVTCRAIGIGAYLVRLGQRTIQVENSHLILTGAGALNKVLGREVYTSNNQLGGIQIMHNNGVTHCTVCDDFEGVFTVLHWLSYMPKNVHSSVPLLNSKDPIDRIIEFVPTKAPYDPRWMLAGRPHPTQKGQWLSGFFDYGSFSEIMQPWAQTVVVGRARLGGIPVGVVAVETRTVELSVPADPANLDSEAKIIQQAGQVWFPDSAFKTYQAIKDFNREGLPLMVFANWRGFSGGMKDMYDQVLKFGAYIVDGLRECSQPVMVYIPPQAELRGGSWVVIDPTINPRHMEMYADRESRGSVLEPEGTVEIKFRKKDLVKTMRRVDPVYIRLAERLGTPELSPTERKELESKLKEREEFLIPIYHQVAVQFADLHDTPGRMQEKGVINDILDWKTSRTFFYWRLRRLLLEDLVKKKIHSANPELTDGQIQAMLRRWFVEVEGTVKAYVWDNNKDLVEWLEKQLTEEDGVRSVIEENIKYISRDYVLKQIRSLVQANPEVAMDSIVHMTQHISPTQRAEVVRILSTMDSPST

SEQ ID NO: 148 - protein, 10 aa, Artificial Sequence
  Consensus phosphorylation site for the AMPK/ Snf1 protein kinase family
  MISC_FEATURE (1)..(1): Xaa = Hyd, wherein Hyd is a bulky hydrophobic side chain, i.e., Leu [L], Met [M], Ile [I], Phe [F], or Val [V]
  misc_feature (2)..(2): Xaa can be any naturally occurring amino acid
  MISC_FEATURE (3)..(3): Xaa = Bas wherein Bas is a basic residue, i.e., Arg [R], Lys [K] or His [H] and wherein Arg is more basic than Lys, which is more basic than His
  misc_feature (4)..(5): Xaa can be any naturally occurring amino acid
  MISC_FEATURE (6)..(6): Xaa = Ser [S] or Thr [T]
  misc_feature (7)..(9): Xaa can be any naturally occurring amino acid
  MISC_FEATURE (10)..(10): Xaa = Hyd, wherein Hyd is a bulky hydrophobic side chain, i.e., Leu [L], Met [M], Ile [I], Phe [F], or Val [V]
XXXXXXXXXX

SEQ ID NO: 149 - DNA, 6801 bp, Yarrowia lipolytica
  CDS (1)..(6801): Locus YALI0C11407g within public Y. lipolytica protein database of the "Yeast project Genolevures" (Center for Bioinformatics, LaBRI, Talence Cedex, France); Acetyl-CoA carboxylase
atgcgactgcaattgaggacactaacacgtcggtttttcagtatggcttcaggatcttcaacgccagatgtggctcccttggtggaccccaacattcacaaaggtctcgcctctcatttctttggactcaattctgtccacacagccaagccctcaaaagtcaaggagtttgtggcttctcacggaggtcatacagttatcaacaaggtcctcatcgctaacaacggtattgccgcagtaaaggagatccgttcagtacgaaaatgggcctacgagacctttggcgacgagcgagcaatctcgttcaccgtcatggccacccccgaagatctcgctgccaacgccgactacattagaatggccgatcagtacgtcgaggtgcccggaggaaccaacaacaacaactacgccaacgtcgagctgattgtcgacgtggctgagcgattcggcgtcgatgccgtgtgggccggatggggccatgccagtgaaaatcccctgctccccgagtcgctagcggcctctccccgcaagattgtcttcatcggccctcccggagctgccatgagatctctgggagacaaaatttcttctaccattgtggcccagcacgcaaaggtcccgtgtatcccgtggtctggaaccggagtggacgaggttgtggttgacaagagcaccaacctcgtgtccgtgtccgaggaggtgtacaccaagggctgcaccaccggtcccaagcagggtctggagaaggctaagcagattggattccccgtgatgatcaaggcttccgagggaggaggaggaaagggtattcgaaaggttgagcgagaggaggacttcgaggctgcttaccaccaggtcgagggagagatccccggctcgcccatcttcattatgcagcttgcaggcaatgcccggcatttggaggtgcagcttctggctgatcagtacggcaacaatatttcactgtttggtcgagattgttcggttcagcgacggcatcaaaagattattgaggaggctcctgtgactgtggctggccagcagaccttcactgccatggagaaggctgccgtgcgactcggtaagcttgtcggatatgtctctgcaggtaccgttgaatatctgtattcccatgaggacgacaagttctacttcttggagctgaatcctcgtcttcaggtcgaacatcctaccaccgagatggtcaccggtgtcaacctgcccgctgcccagcttcagatcgccatgggtatccccctcgatcgaatcaaggacattcgtctcttttacggtgttaaccctcacaccaccactccaattgatttcgacttctcgggcgaggatgctgataagacacagcgacgtcccgtcccccgaggtcacaccactgcttgccgaatcacatccgaggaccctggagagggtttcaagccctccggaggtactatgcacgagctcaacttccgatcctcgtccaacgtgtggggttacttctccgttggtaaccagggaggtatccattcgttctcggattcgcagtttggtcacatcttcgccttcggtgagaaccgaagtgcgtctcgaaagcacatggttgttgctttgaaggaactatctattcgaggtgacttccgaaccaccgtcgagtacctcatcaagctgctggagacaccggacttcgaggacaacaccatcaccaccggctggctggatgagcttatctccaacaagctgactgccgagcgacccgactcgttcctcgctgttgtttgtggtgctgctaccaaggcccatcgagcttccgaggactctattgccacctacatggcttcgctagagaagggccaggtccctgctcgagacattctcaagacccttttccccgttgacttcatctacgagggccagcggtacaagttcaccgccacccggtcgtctgaggactcttacacgctgttcatcaacggttctcgatgcgacattggagttagacctctttctgacggtggtattctgtgtcttgtaggtgggagatcccacaatgtctactggaaggaggaggttggagccacgcgactgtctgttgactccaagacctgccttctcgaggtggagaacgaccccactcagcttcgatctccctctcccggtaagctggttaagttcctggtcgagaacggcgaccacgtgcgagccaaccagccctatgccgagattgaggtcatgaagatgtacatgactctcactgctcaggaggacggtattgtccagctgatgaagcagcccggttccaccatcgaggctggcgacatcctcggtatcttggcccttgatgatccttccaaggtcaagcatgccaagccctttgagggccagcttcccgagcttggaccccccactctcagcggtaacaagcctcatcagcgatacgagcactgccagaacgtgctccataacattctgcttggtttcgataaccaggtggtgatgaagtccactcttcaggagatggttggtctgctccgaaaccctgagcttccttatctccagtgggctcatcaggtgtcttctctgcacacccgaatgagcgccaagctggatgctactcttgctggtctcattgacaaggccaagcagcgaggtggcgagtttcctgccaagcagcttctgcgagcccttgagaaggaggcgagctctggcgaggtcgatgcgctcttccagcaaactcttgctcctctgtttgaccttgctcgagagtaccaggacggtcttgctatccacgagcttcaggttgctgcaggccttctgcaggcctactacgactctgaggcccggttctgcggacccaacgtacgtgacgaggatgtcattctcaagcttcgagaggagaaccgagattctcttcgaaaggttgtgatggcccagctgtctcattctcgagtcggagccaagaacaaccttgtgctggcccttctcgatgaatacaaggtggccgaccaggctggcaccgactctcctgcctccaacgtgcacgttgcaaagtacttgcgacctgtgctgcgaaagattgtggagctggaatctcgagcttctgccaaggtatctctgaaagcccgagagattctcatccagtgcgctctgccctctctaaaggagcgaactgaccagcttgagcacattctgcgatcttctgtcgtcgagtctcgatacggagaggttggtctggagcaccgaactccccgagccgatattctcaaggaggttgtcgactccaagtacattgtctttgatgtgcttgcccagttctttgcccacgatgatccctggatcgtccttgctgccctggagctgtacatccgacgagcttgcaaggcctactccatcctggacatcaactaccaccaggactcggacctgcctcccgtcatctcgtggcgatttagactgcctaccatgtcgtctgctttgtacaactcagtagtgtcttctggctccaaaacccccacttccccctcggtgtctcgagctgattccgtctccgacttttcgtacaccgttgagcgagactctgctcccgctcgaaccggagcgattgttgccgtgcctcatctggatgatctggaggatgctctgactcgtgttctggagaacctgcccaaacggggcgctggtcttgccatctctgttggtgctagcaacaagagtgccgctgcttctgctcgtgacgctgctgctgctgccgcttcatccgttgacactggcctgtccaacatttgcaacgttatgattggtcgggttgatgagtctgatgacgacgacactctgattgcccgaatctcccaggtcattgaggactttaaggaggactttgaggcctgttctctgcgacgaatcaccttctccttcggcaactcccgaggtacttatcccaagtatttcacgttccgaggccccgcatacgaggaggaccccactatccgacacattgagcctgctctggccttccagctggagctcgcccgtctgtccaacttcgacatcaagcctgtccacaccgacaaccgaaacatccacgtgtacgaggctactggcaagaacgctgcttccgacaagcggttcttcacccgaggtatcgtacgacctggtcgtcttcgagagaacatccccacctcggagtatctcatttccgaggctgaccggctcatgagcgatattttggacgctctagaggtgattggaaccaccaactcggatctcaaccacattttcatcaacttctcagccgtctttgctctgaagcccgaggaggttgaagctgcctttggcggtttcctggagcgatttggccgacgtctgtggcgacttcgagtcaccggtgccgagatccgaatgatggtatccgaccccgaaactggctctgctttccctctgcgagcaatgatcaacaacgtctctggttacgttgtgcagtctgagctgtacgctgaggccaagaacgacaagggccagtggattttcaagtctctgggcaagcccggctccatgcacatgcggtctatcaacactccctaccccaccaaggagtggctgcagcccaagcggtacaaggcccatctgatgggtaccacctactgctatgacttccccgagctgttccgacagtccattgagtcggactggaagaagtatgacggcaaggctcccgacgatctcatgacttgcaacgagctgattctcgatgaggactctggcgagctgcaggaggtgaaccgagagcccggcgccaacaacgtcggtatggttgcgtggaagtttgaggccaagacccccgagtaccctcgaggccgatctttcatcgtggtggccaacgatatcaccttccagattggttcgtttggccctgctgaggaccagttcttcttcaaggtgacggagctggctcgaaagctcggtattcctcgaatctatctgtctgccaactctggtgctcgaatcggcattgctgacgagctcgttggcaagtacaaggttgcgtggaacgacgagactgacccctccaagggcttcaagtacctttacttcacccctgagtctcttgccaccctcaagcccgacactgttgtcaccactgagattgaggaggagggtcccaacggcgtggagaagcgtcatgtgatcgactacattgtcggagagaaggacggtctcggagtcgagtgtctgcggggctctggtctcattgcaggcgccacttctcgagcctacaaggatatcttcactctcactcttgtcacctgtcgatccgttggtatcggtgcttaccttgttcgtcttggtcaacgagccatccagattgagggccagcccatcattctcactggtgcccccgccatcaacaagctgcttggtcgagaggtctactcttccaacttgcagcttggtggtactcagatcatgtacaacaacggtgtgtctcatctgactgcccgagatgatctcaacggtgtccacaagatcatgcagtggctgtcatacatccctgcttctcgaggtcttccagtgcctgttctccctcacaagaccgatgtgtgggatcgagacgtgacgttccagcctgtccgaggcgagcagtacgatgttagatggcttatttctggccgaactctcgaggatggtgctttcgagtctggtctctttgacaaggactctttccaggagactctgtctggctgggccaagggtgttgttgttggtcgagctcgtcttggcggcattcccttcggtgtcattggtgtcgagactgcgaccgtcgacaatactacccctgccgatcccgccaacccggactctattgagatgagcacctctgaagccggccaggtttggtaccccaactcggccttcaagacctctcaggccatcaacgacttcaaccatggtgaggcgcttcctctcatgattcttgctaactggcgaggcttttctggtggtcagcgagacatgtacaatgaggttctcaagtacggatctttcattgttgatgctctggttgactacaagcagcccatcatggtgtacatccctcccaccggtgagctgcgaggtggttcttgggttgtggttgaccccaccatcaactcggacatgatggagatgtacgctgacgtcgagtctcgaggtggtgtgctggagcccgagggaatggtcggtatcaagtaccgacgagacaagctactggacaccatggctcgtctggatcccgagtactcctctctcaagaagcagcttgaggagtctcccgattctgaggagctcaaggtcaagctcagcgtgcgagagaagtctctcatgcccatctaccagcagatctccgtgcagtttgccgacttgcatgaccgagctggccgaatggaggccaagggtgtcattcgtgaggctcttgtgtggaaggatgctcgtcgattcttcttctggcgaatccgacgacgattagtcgaggagtacctcattaccaagatcaatagcattctgccctcttgcactcggcttgagtgtctggctcgaatcaagtcgtggaagcctgccactcttgatcagggctctgaccggggtgttgccgagtggtttgacgagaactctgatgccgtctctgctcgactcagcgagctcaagaaggacgcttctgcccagtcgtttgcttctcaactgagaaaggaccgacagggtactctccagggcatgaagcaggctctcgcttctctttctgaggctgagcgggctgagctgctcaaggggttgtga

SEQ ID NO: 150 - protein, 2266 aa, Yarrowia lipolytica
MRLQLRTLTRRFFSMASGSSTPDVAPLVDPNIHKGLASHFFGLNSVHTAKPSKVKEFVASHGGHTVINKVLIANNGIAAVKEIRSVRKWAYETFGDERAISFTVMATPEDLAANADYIRMADQYVEVPGGTNNNNYANVELIVDVAERFGVDAVWAGWGHASENPLLPESLAASPRKIVFIGPPGAAMRSLGDKISSTIVAQHAKVPCIPWSGTGVDEVVVDKSTNLVSVSEEVYTKGCTTGPKQGLEKAKQIGFPVMIKASEGGGGKGIRKVEREEDFEAAYHQVEGEIPGSPIFIMQLAGNARHLEVQLLADQYGNNISLFGRDCSVQRRHQKIIEEAPVTVAGQQTFTAMEKAAVRLGKLVGYVSAGTVEYLYSHEDDKFYFLELNPRLQVEHPTTEMVTGVNLPAAQLQIAMGIPLDRIKDIRLFYGVNPHTTTPIDFDFSGEDADKTQRRPVPRGHTTACRITSEDPGEGFKPSGGTMHELNFRSSSNVWGYFSVGNQGGIHSFSDSQFGHIFAFGENRSASRKHMVVALKELSIRGDFRTTVEYLIKLLETPDFEDNTITTGWLDELISNKLTAERPDSFLAVVCGAATKAHRASEDSIATYMASLEKGQVPARDILKTLFPVDFIYEGQRYKFTATRSSEDSYTLFINGSRCDIGVRPLSDGGILCLVGGRSHNVYWKEEVGATRLSVDSKTCLLEVENDPTQLRSPSPGKLVKFLVENGDHVRANQPYAEIEVMKMYMTLTAQEDGIVQLMKQPGSTIEAGDILGILALDDPSKVKHAKPFEGQLPELGPPTLSGNKPHQRYEHCQNVLHNILLGFDNQVVMKSTLQEMVGLLRNPELPYLQWAHQVSSLHTRMSAKLDATLAGLIDKAKQRGGEFPAKQLLRALEKEASSGEVDALFQQTLAPLFDLAREYQDGLAIHELQVAAGLLQAYYDSEARFCGPNVRDEDVILKLREENRDSLRKVVMAQLSHSRVGAKNNLVLALLDEYKVADQAGTDSPASNVHVAKYLRPVLRKIVELESRASAKVSLKAREILIQCALPSLKERTDQLEHILRSSVVESRYGEVGLEHRTPRADILKEVVDSKYIVFDVLAQFFAHDDPWIVLAALELYIRRACKAYSILDINYHQDSDLPPVISWRFRLPTMSSALYNSVVSSGSKTPTSPSVSRADSVSDFSYTVERDSAPARTGAIVAVPHLDDLEDALTRVLENLPKRGAGLAISVGASNKSAAASARDAAAAAASSVDTGLSNICNVMIGRVDESDDDDTLIARISQVIEDFKEDFEACSLRRITFSFGNSRGTYPKYFTFRGPAYEEDPTIRHIEPALAFQLELARLSNFDIKPVHTDNRNIHVYEATGKNAASDKRFFTRGIVRPGRLRENIPTSEYLISEADRLMSDILDALEVIGTTNSDLNHIFINFSAVFALKPEEVEAAFGGFLERFGRRLWRLRVTGAEIRMMVSDPETGSAFPLRAMINNVSGYVVQSELYAEAKNDKGQWIFKSLGKPGSMHMRSINTPYPTKEWLQPKRYKAHLMGTTYCYDFPELFRQSIESDWKKYDGKAPDDLMTCNELILDEDSGELQEVNREPGANNVGMVAWKFEAKTPEYPRGRSFIVVANDITFQIGSFGPAEDQFFFKVTELARKLGIPRIYLSANSGARIGIADELVGKYKVAWNDETDPSKGFKYLYFTPESLATLKPDTVVTTEIEEEGPNGVEKRHVIDYIVGEKDGLGVECLRGSGLIAGATSRAYKDIFTLTLVTCRSVGIGAYLVRLGQRAIQIEGQPIILTGAPAINKLLGREVYSSNLQLGGTQIMYNNGVSHLTARDDLNGVHKIMQWLSYIPASRGLPVPVLPHKTDVWDRDVTFQPVRGEQYDVRWLISGRTLEDGAFESGLFDKDSFQETLSGWAKGVVVGRARLGGIPFGVIGVETATVDNTTPADPANPDSIEMSTSEAGQVWYPNSAFKTSQAINDFNHGEALPLMILANWRGFSGGQRDMYNEVLKYGSFIVDALVDYKQPIMVYIPPTGELRGGSWVVVDPTINSDMMEMYADVESRGGVLEPEGMVGIKYRRDKLLDTMARLDPEYSSLKKQLEESPDSEELKVKLSVREKSLMPIYQQISVQFADLHDRAGRMEAKGVIREALVWKDARRFFFWRIRRRLVEEYLITKINSILPSCTRLECLARIKSWKPATLDQGSDRGVAEWFDENSDAVSARLSELKKDASAQSFASQLRKDRQGTLQGMKQALASLSEAERAELLKGL

SEQ ID NO: 151 - DNA, 23 bp, Artificial Sequence
  Primer REG1-1230F
gaacctggtctgtttctcatggt

SEQ ID NO: 152 - DNA, 18 bp, Artificial Sequence
  Primer REG1-1296R
cggacaactcgggtcgat

SEQ ID NO: 153 - DNA, 21 bp, Artificial Sequence
  Nucleotide portion of primer REG1-1254T
cgatcttcgtcctcggcatct

SEQ ID NO: 154 - DNA, 20 bp, Artificial Sequence
  Primer HXK1-802F
tcatccccgacagcattgat

SEQ ID NO: 155 - DNA, 22 bp, Artificial Sequence
  Primer HXK1-863R
gaaggctccatactcgcaattg

SEQ ID NO: 156 - DNA, 18 bp, Artificial Sequence
  Nucleotide portion of primer HXK1-823T
ccgagacccccatggccg

SEQ ID NO: 157 - DNA, 20 bp, Artificial Sequence
  Primer HXK2-738F
tctctggtggcagccaacta

SEQ ID NO: 158 - DNA, 19 bp, Artificial Sequence
  Primer HXK2-799R
atgcctgtgccgagaatga

SEQ ID NO: 159 - DNA, 21 bp, Artificial Sequence
  Nucleotide portion of primer HXK2-759T
atttccaacgctcccctgtgt

SEQ ID NO: 160 - DNA, 20 bp, Artificial Sequence
  Primer GLK1-105F
gccctctcagcaaacatgga

SEQ ID NO: 161 - DNA, 19 bp, Artificial Sequence
  Primer GLK1-168R
tgggaattcgggtgacaaa

SEQ ID NO: 162 - DNA, 23 bp, Artificial Sequence
  Nucleotide portion of primer GLK1-126T
agagcaatgcccatgattccctc

SEQ ID NO: 163 - DNA, 21 bp, Artificial Sequence
  Primer RME1-853F
tgcgtctgtgcaagtgtgact

SEQ ID NO: 164 - DNA, 18 bp, Artificial Sequence
  Primer RME1-919R
tcgggcatggacgaaaag

SEQ ID NO: 165 - DNA, 20 bp, Artificial Sequence
  Nucleotide portion of primer RME1-881T
ctgcgtgtggtccctgatcg

SEQ ID NO: 166 - DNA, 20 bp, Artificial Sequence
  Primer ACS2-YL-1527F
ccgagacaatgacggctttt

SEQ ID NO: 167 - DNA, 19 bp, Artificial Sequence
  Primer ACS2-YL-1598R
agacggtggccagaaacgt

SEQ ID NO: 168 - DNA, 22 bp, Artificial Sequence
  Nucleotide portion of primer ACS2-YL-1548T
ctggatccgaggccgagtcgac

SEQ ID NO: 169 - DNA, 21 bp, Artificial Sequence
  Primer SKS1-784F
tcctgcctgttagcgatgagt

SEQ ID NO: 170 - DNA, 19 bp, Artificial Sequence
  Primer SKS1-846R
acttgacatcggcggtgaa

SEQ ID NO: 171 - DNA, 20 bp, Artificial Sequence
  Nucleotide portion of primer SKS1-806T
tgccggcattctcaaccgca

SEQ ID NO: 172 - DNA, 19 bp, Artificial Sequence
  Primer CBR1-461F
cgagtccttcggcatggtt

SEQ ID NO: 173 - DNA, 23 bp, Artificial Sequence
  Primer CBR1-527R
aatgtgtcgcagaatctggtaca

SEQ ID NO: 174 - DNA, 21 bp, Artificial Sequence
  Nucleotide portion of primer CBR1-482T
tggaggaaccggcatcacccc

SEQ ID NO: 175 - DNA, 17 bp, Artificial Sequence
  Primer SCS2-310F
ggacccaggccgaacac

SEQ ID NO: 176 - DNA, 22 bp, Artificial Sequence
  Primer SCS2-371R
cacctgcaccttcatctttttg

SEQ ID NO: 177 - DNA, 21 bp, Artificial Sequence
  Nucleotide portion of primer SCS2-328T
ccaagtccgtgcccatcacca

SEQ ID NO: 178 - DNA, 20 bp, Artificial Sequence
  Primer SNF3-999F
ggacgacgaaagctgctgtt

SEQ ID NO: 179 - DNA, 20 bp, Artificial Sequence
  Primer SNF3-1066R
acagccgccacgataaactc

SEQ ID NO: 180 - DNA, 23 bp, Artificial Sequence
  Nucleotide portion of primer SNF3-1020T
atcggagctatcgtcatgtgctc

SEQ ID NO: 181 - DNA, 1578 bp, Yarrowia lipolytica
  CDS (1)..(1578): DGAT1
  ref <302>: TITLE: DIACYLGLYCEROL ACYLTRANSFERASES FOR ALTERATION OF POLYUNSATURATED FATTY ACIDS AND OIL CONTENT IN OLEAGINOUS ORGANISMS
  ref <310>: PATENT DOCUMENT NUMBER: U.S. 7,273,746
  ref <311>: PATENT FILING DATE: 2004-12-29
  ref <312>: PUBLICATION DATE: 2007-09-25
  ref <313>: RELEVANT RESIDUES IN SEQ ID NO: (1)..(1578)
  ref <302>: TITLE: DIACYLGLYCEROL ACYLTRANSFERASES FOR ALTERATION OF POLYUNSATURATED FATTY ACIDS AND OIL CONTENT IN OLEAGINOUS ORGANISMS
  ref <310>: PATENT DOCUMENT NUMBER: WO 2006/052914
  ref <311>: PATENT FILING DATE: 2005-11-03
  ref <312>: PUBLICATION DATE: 2006-05-18
  ref <313>: RELEVANT RESIDUES IN SEQ ID NO: (1)..(1578)
atggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccag

SEQ ID NO: 182 - protein, 526 aa, Yarrowia lipolytica
MEVRRRKIDVLKAQKNGYESGPPSRQSSQPSSRASSRTRNKHSSSTLSLSGLTMKVQKKPAGPPANSKTPFLHIKPVHTCCSTSMLSRDYDGSNPSFKGFKNIGMIILIVGNLRLAFENYLKYGISNPFFDPKITPSEWQLSGLLIVVAYAHILMAYAIESAAKLLFLSSKHHYMAVGLLHTMNTLSSISLLSYVVYYYLPNPVAGTIVEFVAVILSLKLASYALTNSDLRKAAIHAQKLDKTQDDNEKESTSSSSSSDDAETLADIDVIPAYYAQLPYPQNVTLSNLLYFWFAPTLVYQPVYPKTERIRPKHVIRNLFELVSLCMLIQFLIFQYAYPIMQSCLALFFQPKLDYANISERLMKLASVSMMVWLIGFYAFFQNGLNLIAELTCFGNRTFYQQWWNSRSIGQYWTLWNKPVNQYFRHHVYVPLLARGMSRFNASVVVFFFSAVIHELLVGIPTHNIIGAAFFGMMSQVPLIMATENLQHINSSLGPFLGNCAFWFTFFLGQPTCAFLYYLAYNYKQNQ

SEQ ID NO: 183 - DNA, 2119 bp, Yarrowia lipolytica
  CDS (291)..(1835): DGAT2
  ref <302>: TITLE: ACYLTRANSFERASES FOR ALTERATION OF POLYUNSATURATED FATTY ACIDS AND OIL CONTENT IN OLEAGINOUS YEASTS
  ref <310>: PATENT DOCUMENT NUMBER: U.S. 7,267,976
  ref <311>: PATENT FILING DATE: 2004-07-01
  ref <312>: PUBLICATION DATE: 2007-09-11
  ref <313>: RELEVANT RESIDUES IN SEQ ID NO: (1)..(2119)
  ref <302>: TITLE: ACYLTRANSFERASES FOR ALTERATION OF POLYUNSATURATED FATTY ACIDS AND OIL CONTENT IN OLEAGINOUS YEASTS
  ref <310>: PATENT DOCUMENT NUMBER: WO 2005/003322
  ref <311>: PATENT FILING DATE: 2004-07-02
  ref <312>: PUBLICATION DATE: 2005-01-13
  ref <313>: RELEVANT RESIDUES IN SEQ ID NO: (1)..(2119)
aaacgcacccactgctcgtcctccttgctcctcgaaaccgactcctctacacacgtcaaatccgaggttgaaatcttccccacatttggcagccaaaccagcacatcccagcaacctcgcacagcgccgaaatcgacctgtcgacttggccacaaaaaaaagcaccggctctgcaacagttctcacgaccaattacgtacaagtacgaaatcgttcgtggaccgtgactgataagctcccactttttcttctaacaacaggcaacagacaagtcacacaaaacaaaagctatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaaggaaaactgcctgggttaggcaaatagctaatgagtatttttttgatggcaaccaaatgtagaaagaaaaaaaaaaaaaaagaaaaaaaaaagagaatattatatctatgtaattctattaaaagctctgttgagtgagcggaataaatactgttgaagaggggattgtgtagagatctgtttactcaatggcaaactcatctgggggagatccttccactgtgggaagctcctggatagcctttgcatcggggttcaagaagaccattgtgaacagcccttga

SEQ ID NO: 184 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIISTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 185 - DNA, 18 bp, Artificial Sequence
  Primer SNF-1230F
ccatcgggccaacatgat

SEQ ID NO: 186 - DNA, 23 bp, Artificial Sequence
  Primer SNF-1293R
cgatgagatgggattcagcttac

SEQ ID NO: 187 - DNA, 20 bp, Artificial Sequence
  Nucleotide portion of primer SNF-1250T
cccatggtcccgctaccctg

SEQ ID NO: 188 - DNA, 41 bp, Artificial Sequence
  Primer ACC1-F
gatcaaccatggtgcgactgcaattgaggacactaacacgt

SEQ ID NO: 189 - DNA, 30 bp, Artificial Sequence
  Primer ACC-NotR
tcgaccctttttcgaccctttttggtcgtt

SEQ ID NO: 190 - DNA, 30 bp, Artificial Sequence
  Primer ACC-NotF
agttatcaacaaggtgagtatttgacgttt

SEQ ID NO: 191 - DNA, 44 bp, Artificial Sequence
  Primer ACC1-R
gatcaagcggccgctcacaaccccttgagcagctcagcccgctc

What is claimed is:

1. A transgenic oleaginous *Yarrowia lipolytica* host cell comprising:
   (a) a heterotrimeric SNF1 protein kinase signaling network having reduced activity when compared to the activity of a heterotrimeric SNF1 protein kinase signaling network of a control *Yarrowia lipolytica* host cell, wherein said reduced activity is due to:
      (i) down-regulation of a polynucleotide encoding the SNF1 alpha-subunit of the heterotrimeric SNF1 protein kinase, wherein the SNF1 alpha-subunit is an amino acid sequence having at least 95% amino acid identity with SEQ ID NO:27;
      (ii) up-regulation of a polynucleotide encoding the regulatory domain of the SNF1 alpha-subunit, wherein the regulatory domain of the SNF1 alpha-subunit is encoded by nucleotides +835 to +1740 of SEQ ID NO:26; or
      (iii) up-regulation of a polynucleotide encoding a catalytically inactive SNF1 alpha-subunit having at least 95% identity with SEQ ID NO: 27; and
   (b) an increase in total lipid content when compared to the total lipid content of said control *Yarrowia lipolytica* host cell;
   wherein said control *Yarrowia lipolytica* host cell does not comprise (i), (ii), or (iii).

2. The transgenic oleaginous *Yarrowia lipolytica* host cell of claim 1, wherein the reduction in activity of the heterotrimeric SNF1 protein kinase signaling network of said transgenic oleaginous *Yarrowia lipolytica* host cell is due to said up-regulation of the polynucleotide encoding the catalytically inactive SNF1 alpha-subunit.

3. The transgenic oleaginous *Yarrowia lipolytica* host cell of claim 1, wherein the reduction in activity of the heterotrimeric SNF1 protein kinase signaling network of said transgenic oleaginous *Yarrowia lipolytica* host cell is due to said down-regulation of the polynucleotide encoding the SNF1 alpha-subunit of the heterotrimeric SNF1 protein kinase wherein the SNF1 alpha-subunit is an amino acid sequence having at least 95% amino acid identity with SEQ ID NO:27.

4. The transgenic oleaginous *Yarrowia lipolytica* host cell of any one of claims 1-3, wherein the polynucleotide encoding the SNF1 alpha-subunit comprises a nucleotide sequence encoding a polypeptide having SNF1 protein kinase activity, wherein the amino acid sequence of the SNF1 alpha-subunit is SEQ ID NO:27.

* * * * *